United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 13

SEQ ID NO: 13810 - DNA, 1936 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13811 - DNA, 1493 bp, Homo sapiens
aaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctgcccttgtttggggcaggagtagctgagctcacaaggcagcaaggcccgagcagctgagcagggccggggaactggccaagctgaggtgcccaggagaagaaagaggtgaccccaggg

SEQ ID NO: 13812 - DNA, 3030 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13813 - DNA, 3050 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccaca

SEQ ID NO: 13814 - DNA, 2885 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagcctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagcc

SEQ ID NO: 13815 - DNA, 2792 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagcc

SEQ ID NO: 13816 - DNA, 5706 bp, Homo sapiens
acgagagggcgcagcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacagttcggtttttgcccactagggatgatgtggtttctcatgaggttacttgctctaaaggactttatattttggaaccataagagcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtg

SEQ ID NO: 13817 - DNA, 6466 bp, Homo sapiens
ggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacaggtgcacgctaccatgcccggctaatttttgtatttttagtagaggcgggggtttcaccatgccatccaggctggtttcgaactcctgacctcgtgatccacctgtctcggcctcccaaagtgctgggattacaggtgtgagccaccgcgcctggccctgtattttcaaattctttacctctgcgtttccagccttgctccatccaatttgttactagagctttttaacaatttcacgttgaattaagatgatttggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcagagaagatatgccttgcctgctgccatacattgtaacatcaagtcaagagctttagttacttaacagatttctgctggctgctattataggaggaaactcctttgtttagggacagccagggcttccttagctttgatctttgggagtgagccttttgcttgacttcccttctcttttccatgcctttgtttccatctcgaagtgcaaatttaaagtgtcctgtttgcctttatccactggaaggcaaacaccctggacgacgtatcagtgacagcgcggttctgctttgatcggagcacccagcgctgcttgaaggcgtttgcatggtccatggctcatggaccacgctcctagaaaacggaaatgcacttagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtg

SEQ ID NO: 13818 - DNA, 702 bp, Homo sapiens
catgctcatcacgctgtgctacctgtacctgtgggcgcgctggggtcgccggccggctgagctcgtgcgcgccacggtgcggcggctgcgtgcctcgcgctgttccttcaccttctgcggcgcggccgcgcagcccccgggcgcccgcgtgtgcctgagccgtggcggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctgg

SEQ ID NO: 13819 - DNA, 666 bp, Homo sapiens
agcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggaga

SEQ ID NO: 13820 - DNA, 780 bp, Homo sapiens
ggccgcccggggctctggggactcgggtgtccaggtgccgaagtcgccgcttccacgggggactcaggcccgtgagtgggtttcctaagaacttaccagattccacggctcgggtttcctgccttggatcctgctttttattccccagggggagttatttatagacaggaatcgtgtgttcaaggcctggctcttcggactcggcgtttttcttgttcgaggtgcttcaatgggggctggatgccatcatcttccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggag

SEQ ID NO: 13821 - DNA, 2277 bp, Homo sapiens
gtgcgtgagaacgccggcggtgaccgcagccacagcggtgaccgagtgagaggaaggcggcggcggcggcggcggcggcgtgaagtcactgctgctctgggttcgggttggcgactgaaggcggtaccggcctcccggaacagcccgggggagggcttaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggt

SEQ ID NO: 13822 - DNA, 1072 bp, Homo sapiens
ggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 13823 - DNA, 1000 bp, Homo sapiens
ccgagtgagaggaaggcggcggcggcggcggcggcggcgtgaagtcactgctgctctgggttcgggttggcgactgaaggcggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 13824 - DNA, 2517 bp, Homo sapiens
aggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcgccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaa

SEQ ID NO: 13825 - DNA, 2016 bp, Homo sapiens
tttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcgccacccccagccggctacctaccagacttccgggaacctgggggtgtcctactcccactcaagttgtggtccaagctatggctcacagaacttcagtgcgccttacagcccctacgcgttaaatcaggaagcagacccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaa

SEQ ID NO: 13826 - DNA, 2541 bp, Homo sapiens
atgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaatttta

SEQ ID NO: 13827 - DNA, 1569 bp, Homo sapiens
aaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagcttt

SEQ ID NO: 13828 - DNA, 1570 bp, Homo sapiens
aaccaaagtctctcaagttgctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaa

SEQ ID NO: 13829 - DNA, 2295 bp, Homo sapiens
cttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaa

SEQ ID NO: 13830 - DNA, 4376 bp, Homo sapiens
actggggtcttctccatgcggctcgggctatgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcggcggccgcggctgcggcggcggccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcgggcgcagaggccgccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacatgatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtattacaaaagggagagaaaagaaaggaggaagagatagtatgaattcccaggctccctgtggaaaatgaaaaccagttgttttgtagcagcaatgcctaggctgtcgtattttaaaatctgctgttgggtctgcatgtgtctgagagggcaggttttgatatttgttgaaatgacaggactacgaaaggccttaaaccttgaccttgacgaaaaaaaagacaatttgtgaccttgacttttgacagctcatgaattggccttagctggattagtagatcaagggcgccacctcgcgttgacaagcctccttgtaattcttcaaccaagggaatcaagagctcttacctccttgactttagagattcagtactcaattatttggctccagctggagcaaatttgaatatatgtaaattatacatgtccctgtatatatgtaaatatatataatatgtgtacacatgtatacatttgcatattagtgcttgtgtgtgcttgtatatatatttgtagaatctgtacagatatcatatcattaattgctaatgacgcaagatattgtaatttaaggtgatttctagaattgaggtacaaaatgtactttacaagatgaagccttgttccttttctctaatggccaaatttgatttgtcttcacagtggcttgctctgcatcagatttctgcagatctgctttaaagctgtacatttttgttacagtctaagatgtgttcttaaatcaccattccttcctggtcctcaccctccagggtggtctcacactgtaattagagctattgaggagtctttacagcaaattaagattcagatgccttgctaagtctagagttctagagttatgtttcagaaagtctaagaaacccacctcttgagaggtcagtaaagaggacttaatatttcatatctacaaaatgaccacaggattggatacagaacgagagttatcctggataactcagagctgagtactgctccagggtggtgtgcaatcttatattgatgcttgtgaatctgccatttgatttgtaggataaataaatatgtttaatattaacaacttccatcaaaactataataataatattatatctactgttgacctctaacaacaatcaggtgctgtattcagagtcataaagaatacatatgtatgtttgtatatttaatatacacataggataatgtgtttttgtcaaatctatgctatgcgcatatgtattaaaatgttggtggaatcagtagccgtgggatgcagaattgtgagatgcaggctaattttatctttacgttagaggaaagtaatagtgaatggaagaaccagattcatcattttatggaaaataatattgattggttacaaaagtggctgccggaaacctctccaacctctcctgaggactcacaacttctttatagatgagaattacgaaagagtctctaaagctgtctcaaaaacaggctggtgttgaaacatacatatcgaaaggtctcgagaaattcaattatattttgctgccctgaggattttcactccacttgtggaaacaaatgataatgttgcttcagacccacctctccacctcttgttccaaacagtactccatttccaaatgagctgccatcaag

SEQ ID NO: 13831 - DNA, 2066 bp, Homo sapiens
cccgacttttttggatcaatcaaacagacagtggcttcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggattttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagtagcttatttttctccccctcttttttcaaggctcataacgggttctttttcttcttttagtctaacttcgtaaataaaattcgtcacaatttatcctcttttttcaattttaatacatttattaaggcggcatgttcaaagtcttcaatggacagcaacaaaacagaaagccaaaaaatgactagggcttctaataagtgttttttctttcttttttgcttcttcttctcctctttctttttaaaggatttga

SEQ ID NO: 13832 - DNA, 1747 bp, Homo sapiens
ggcctcggcaagcccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattca

SEQ ID NO: 13833 - DNA, 1595 bp, Homo sapiens
atgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtgggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccattt

SEQ ID NO: 13834 - DNA, 1657 bp, Homo sapiens
gggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatgacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgtgtaattaatgctgttgtagaggtgacttgatgagacacaacttgttcgacgtgtagtgactagtgactctgtgatgaaaactgtgactccaagcggtgtgtccctgcgtgcctttataggaccctttgcacgaactctggaagtggctcttataagcgcagcttcagtgatgtatgtttttgtgaacaaagttacaaatattgtccaagtctggctgttttaagcaaactgtgatcagcttttttttttttttttttttttttgtatttgtttttaaggaaaaaatactgactggaacaaaaaataaactttctattgtaagttc

SEQ ID NO: 13835 - DNA, 989 bp, Homo sapiens
cacagtcctgcagaggggcgcgcaaatgagttcctattttgtgaatcccactttccccgggagccttcccagcggccaggactccttcttgggccagctgcccctctaccaggctggctatgacgcgctgaggcccttcccggcctcgtacggggcgtcgagtctcccggacaagacgtacacctcaccttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacaccca

SEQ ID NO: 13836 - DNA, 2020 bp, Homo sapiens
acgtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctttgctcccaactcacagagaagcggctacggggcgggcgccggcgccttcgcctcgaccgttccgggcttatacaatgtcaacagccccctttatcagagcccctttgcgtccggctacggcctgggcgccgacgcctacggcaacctgccctgcgcctcctacgaccaaaacatccccgggctctgcagtgacctcgccaaaggcgcctgcgacaagacggacgagggcgcgctgcatggcgcggctgaggccaatttccgcatctacccctggatgcggtcttcaggacctgacaggaagcggggccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaatgtaaaaaacaaaaacaaaaacaaaaaagcaacccagtccccaacctgcactctacccacccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgcaagaaagtgaatctcactactacctactcccctaaaactacctattttgtgctggctggcttgcctgctacctagtgccgactgctcccaggcaagtcccctgctgcttacagcccgcagcttttggggtccctgaggctgccctgagaatgtgctgaggtccaggatcagggtattggcatctatttaaatcgaaaaataatatatttattccaaaaagcatcctaagtgcttgcaccctagaatcaatccctccttctctggcttggcacccacagctcaggcccatcaacccccacttctggaggggaatgttcctgagctggctgcagatctgtgggttagcttctgcttagcaggactgtggagatgcttccagcttcgctgtcctttcctctggctcctgtatcttactgttcagctgtgttaaatatgtacgccctgatgtttcctataatagcagatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtaaccgaaaataaagatgcgtggtgacaaagaaaaa

SEQ ID NO: 13837 - DNA, 585 bp, Homo sapiens
gggcagtttatgaggcgtttaggggaagggttctccccaccatcctccaccgagcggtgggcggcaggggcttcagctggtgcaacatggtgcaggggtcggaggcctggaagggcggataaacagtgtgcctccgattaaggaaaggaagctgggagacgttgactttattcgaaccacatggctccagtttgcggtggcaatctctctgcagctgcaagagatgctgcgccttccccgtctggatccgagtctaagtccggcctgtcgcccactggacctgggcggctgcgggccctgcggagcgagaccacctgtgaggactgctgagattggcggaggcggtcatgtgggcggtcacgtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctt

SEQ ID NO: 13838 - DNA, 1956 bp, Homo sapiens
caccactggggcggcaactactacgtggactcgttcctgctgggcgccgacgccgcggatgagctgagcgttggcatgcgccggggaccctggcctccccggcaggcggcgacgctggccgagcaccccgacttcagcccgtgcagcttccagtccaaggcgacggtgtttggcgcctcgtggaacccagtgcaccgggcgccaacgctgtacccggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttct

SEQ ID NO: 13839 - DNA, 2037 bp, Homo sapiens
agtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttcta

SEQ ID NO: 13840 - DNA, 1755 bp, Homo sapiens
atggcagggttctctccttggcggcggcggcagcggcggaggcggcggcggcggcgggcgaggcagtcgcgggcagcaccagaactggtcggtgatttaggtagtttcctgttgttgggatccacctttctctcgacagcacgacactgcttcattacttcagttgaaatcgtctccaggtacctctgcgcgcgggggtcgggccgggcggggcatcacggccctggtcgtgccaggcctgcggtggcaacctcggctttccctgctcaggagcctcgtgtctttctccgcagcgctttgccagccggccggctttccccttccaccacacacctccacctggtcacagcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttct

SEQ ID NO: 13841 - DNA, 1358 bp, Homo sapiens
attcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagaggaaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggggatcctctctagggctgaaatgccagtttagagctgcctgggggtgggaggggggatggggaaacatttttctcagacctgggtggctgggggccctacaggaccagaggcctgggaggcatggaacctgtcaaatgtagagggaagggcttctgcctttgatctggggatcagctcagtgtcaacatgtggtgggggtgggggccagcctcatcctcctggattcatcctcctttcccttccaacttgggtttatt

SEQ ID NO: 13842 - DNA, 3467 bp, Homo sapiens
aggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaa

SEQ ID NO: 13843 - DNA, 528 bp, Homo sapiens
ccccgctgcccccccggcccccgagttcccttggatgaaagagaagaaatccgccaagaaacccagccaatccgccacgtctccttctccggccgcctccgccgttccggcggggtcggatcgcctgcagatggcctgggacggaggctggtggcggcggggcaggctgcgcacggcttacaccaacacgcagctgctggaactggagaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggccccctcgcgggcggcgtgggaagcctgctgtcacccgccggaggtggtgccgggggccttaagcgcggacccccggcctttagccgttcgcttagaggg

SEQ ID NO: 13844 - DNA, 2652 bp, Homo sapiens
cttttttcttttttaactagcacaatggcaaaaatgggagggaaagtctctttgtcctaggggaaaatctccccaccacactcatgcacacacataacgctgatctgaactttgagagtgctctaagttaaaccaatggctacctcagttcttgttcatgtccctggatatggatacagatacaagcttgaggcttgagtgggtacatgcacatcttagactctgcctgtttttgggggatgtcacagagaagcatggaagcctgaaagtgaggaaagcaggggtacataaggggcagaggcagtgctgcaaacactgggcagagaagagaacccagaccatacagcgatggaggccagaggcccaaaaatgccccttatgctccatctcactcctatgtgtctgcctgggagttcctgtccatttcccaagatttaactgttgtttttggagggtaacagggatagtggtgtgatgattgtaaatctctttcttattttcaccttaatactgacctttttcaaagagtggaagcctctttcgactccctcttcctccaacgcggagatcctcactcatcttttcctggggaaggggagaagggaaggggatgctgctggccacgtaaagaaggccttaatttactctattaaaatacttggaaaagaggaaggtttctcccttagagtctcttcttttccaggcttctgaaaccttctaaccttcgaaggggatgaggaaaaggttcctctagcttttctggagaaacggaggcattggggagagagcatgtgaggcactggtgtaggaatgggggctcatggtgtcctggtcgtggtcctctggtgtttttgaatcaattaaaccaaataatgctctctgttttccaccaggcccagacgagcgattggcggaggccggtcccgtgaccacgaattccctgtaatttcgctggagtcctgggtttaatagagagagtccccatacgcttgtatttatcagcaatatacaattataaaggcccaaaattaaaaaaaagagagaccgaaatctccccctcccaaaatcgctccattacataaatcggggggggtgcaggaggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaa

SEQ ID NO: 13845 - DNA, 2642 bp, Homo sapiens
ttttgcattcctccagcttgcagctccggtagttggaggctgggtagggcagggggaaccgacaggccggtgtccccagccgcaaaagagctgctgaactgtccgtttaaatgctgctgggagactcgtaaaaaaatcatcgtggacctggaggatgagaggggcgagctttatttcggtcggattgcggtgtggtggtttagctgcaaggggatgccgcagccccagttgagggggaaaatagttcttaaaaagcatatgcccccctaaggaatgtctctaaagaaccaaatcaaagctgctctttggaaggtatgaatagaatttaaaaaaaaaagatttctatggagcttaaagttcacagccattctgtgtagacaagagctaagaaaaatgtgagaattatacagaaaaccattaatcacttcttttctttaaatacgtatcctctctcctttgttattattcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatccttt

SEQ ID NO: 13846 - DNA, 1525 bp, Homo sapiens
actttaactgctcgctgtggtggggaagggggcagaggtaggtgagcactctcccagcctggagcagccggaccagcccagaaggcagcggcggcccaggccagcattcccgcagacacaagaggcttaagtacggcaaagcctttcatatcgtgatttatttgtcataagcaaataaaatgcggttaagctgtctccttttagacagaaggctctttggttattaaagttccgagagaggattccatgaggctggcctctttcctcgcagcataagaagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaa

SEQ ID NO: 13847 - DNA, 4208 bp, Homo sapiens
ggagttgaacagctaggctgaatgagattaaagttttccaaacacacatggcagtatggaggttttatgaaaagtgatggtgaagagttgggagagatggagggaaaaaaatgcagtcagaagtttcagaacaaatacacaaaatcctatgttagtttgaatctttatttttctggcacacttttaaaaggctgtattaaaatagtgattttttttttttgcctcagggaacctcagtcaacaggaatacctctgtttctaacctagagaataatattgttaaaattgctttgttaatttttttttcctcaggaataattttctcttttggaaagcactttccccgtctcagtagaaaagtctagcagttgtaacttcttgtttcttatttgctttgggggaaatcaaagaaaacagacggtgaaggaaagggtgggaaaaattaagtctcatgaaaaaaaaaaaaagaggtccggggagagacctgggccaaatggtcacagcaccaactggcgtggcccaggaaattgaaacaatcctgctccatgtgggggccccacagggccactggctgcccgatcccaggtttggctgagcaaagacaagggctggaggtggtggtacctgcagcagggccatggacagatgagtctcggttcagctggctcttgaggttaaaaatcatcaggaagtttctaggtcaggctgttgttgtcttcctggtgggagagtggtgggaagtggagaggatacctcacaagagaagcttctctgctgaacttgcttctcctgcctgttcttttaggagatcctttggttttccttcaggctagactttgcttgggcaagagacctaaaccgacttggaaggaggcaaaggctggaagcatagaagcctctgggctcagaggagggtgttgatgatgcttttattttggagtctcctagtgtcccctcccttgagccatcctatcccagagttggggaggagagatagggagagagggactaggggaggtcaggggctagtgcacaggcaggagagaagcaatggcctttgccatagattctacatctaggcagtcttgaaaggcatatagtctttatttatttttttattttttagtggaaatgaaaactggtgggcttttttttctcagcatctgctttggagatgttggggaggggaaaagaaaaaaccctattgatgtcagttcccttttcagttcctaagatggattcgagccccagtcctcttctcccccttgtgtctcttctctcgcctcgcaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatcctttaaaaaataagaaaacacatttcaaacccaaaaggcacaaaacacgttcccttccaactttcccaaaacctcaaatttgttcccatttgaggtttattgaggtacacttctagcccccggtttttctgctctagaacattcatatctatacatcccacccccatcaattacagtttttagagggctcagggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacagggtatatttgaacaaactgtcccaggcaggggctgggcagggcctgtgtgccttgctcagcctcctgacaggacacttttgttgcacttagaatttacattttaatggatgtaaaaacaactgtgagagatgtctgggcctgcagaagtccagcattgctcaaaaaagcgtgtgttctagtgaacattttcatatatatttattggttatagcctgttaaaatattttcttttttgtattatttatccccctacattatgtatttatatgagggaaaaaaaggaaaaaattgtacttttttagtatttacctgttacaaaggacattgtgtttcctgtcatgtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaatttta

SEQ ID NO: 13848 - DNA, 1909 bp, Homo sapiens
gacactttaactgctcgctgtggtggggaagggggcagaggtaggtgagcactctcccagcctggagcagccggaccagcccagaaggcagcggcggcccaggccagcattcccgcagaggggagatttgtcgcctgccgctcgctctggggctcgatgtgaatatatattatgtctgcctgttctcccctcgtcggtggctaaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatcctttaaaaaataagaaaacacatttcaaacccaaaaggcacaaaacacgttcccttccaactttcccaaaacctcaa

SEQ ID NO: 13849 - DNA, 1420 bp, Homo sapiens
ttaactgctcgctgtggtggggaagggggcagaggtaggtgagcactctcccagcctggagcagccggaccagcccagaaggcagcggcggcccaggccagcattcccgcagcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtga

SEQ ID NO: 13850 - DNA, 1279 bp, Homo sapiens
atgaggctggcctctttcctcgcagcataagaagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaa

SEQ ID NO: 13851 - DNA, 1845 bp, Homo sapiens
atagtaactgcctgctcgtgggggaggctgggagagaggtgaaccgcaggtcacggcgtctaaaaattattaaaatgtttgagagcctcgtgacgcgcctagctgtttaacaaagactgccaaagtatgagattaacacgaaaacttgcgcttccaaaacaaaaacacaccaaaaaaaaaagtcacgttccggcttctgagggagcccgtggctgtgtccgccgccgcggtccggttttccggacacacaatagtggacaggagagagctcagctgttgcccggcgcgtccgcgggcggctcggcggccggcggggctggggagcctcccgcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggca

SEQ ID NO: 13852 - DNA, 2196 bp, Homo sapiens
agtatatttcacattctccagaatgttaagtgacactttaactgctcgctgtggtggggaagggggcagaggtaggtgagcactctcccagcctggagcagccggaccagcccagaaggcagcggcggcccaggccagcattcccgcacaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcag

SEQ ID NO: 13853 - DNA, 3757 bp, Homo sapiens
gagaattgaaaaccttgtaatcccaagaacagactcgcactgcctttttctgttcccagagctcaaaactagaacaaaacgaaataaaaccaaagcactcaaaccacaccccaaacgaagaaggcgcggaaagtaggagaactggaaaatttctgggccaagaagatctgtctgtcttctgtatataccctgtagatccgaatttgtgtaaggaattttgtggtcacaaattcgtatctaggggaatatgtagttgacataaacactccgctcttatttttccagaagaaaaaaatatatatatatgtatatgtagtatttttctgaatgaggacagtctggtgactggccacacgaagactccttcctctttattcctctatcttttcctccttcaactggttagagatggagaaatcatctacctgaactctccccacgcctgcccctgggagccttggtcccttttcacatctctttaagaggttaatgttattgttgttgaagttttaaatttatcttctcgtcccaaacgcacccattttctattctgggctcagggaggctttattggaaattgcgaaaaaaaatgacttgtcttcagtgtgcgaagaaggcaaaggaaatttgtttaacaaacggatgctgaggccgcctttccgtttcagttcagaacaagatgacctggaaatactcgattaccaaggagtgttattgtctgtgtgggtcacctctatggctgtatccccagtatcaaagggatgtgagatttctattcgccgcggaggcggcgacaattagaacgtctcggacccatggttagtattgctcgggtggttatggaattagcaaattgctaatcaattttgctctcaaaagttgcaggtttttttaccccagcgctctgtctatagtgtgggaaaccaagtcgtttctccaggcttgggccgtgtgggttaaagggaggagtggataggagaagggggacagacggactgacggacacagtctagctaaccgtgcagctaaatgagatttggaaggcgaagtctccccgaattagtgcatgaatttcctatcgatccgcccgcggttccattcatctctgacaagtccctctgcgcacccgccctctagctctggacgcctcctctctcacccctacccttccccatccagctgcagagaaaagccccaagctctgtgctctggcccccgtatgggttcccctttcgagacggagcccccaacccgccagtaacctaactccccatagagacgcagggtgctagcgctccctcccgccgaggggaggagactggggcctttggaaggtacagaatgctgggcagaggtgaggcagaacaggagggctacaccgggagccccaacttcttaagggatctagggtttgcgctctgcctagcgccccaacaggccctccagtcgcaacctgcgcgcgctctctctctcgctctctctctgatcccggagagagcgaggcaaggagggggtcgccccgcaggagccctatgtaaatcctggtgttgggtgggtgggtggggagggggaagggaagaaggggaaataaacctctttggctggagtggggtccgggtgagcagatttccttatccgggaatcgcaggcggggcggccattggctcggaggatcacgtgggcgcctaactttgttcacttgacagtaagtaggagggctttcggaaacaggaaaacgagtcaggggtcggaataaattttagtatattttgtgggcaattcccagaaattaatggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggcccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttcctttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcaggaaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagtctgggaggaggatgttgcagagccctctcccatagtttattatgttgcatcgtttattattattattgataatattattattactatttttttgtgtcatgtgagtcctctctccttttctctttctgacattccaaaaccaggccccttcctacctctggggctgcttgagtctagaacccttcgtatgtgtgaatatctgtgtgctgtacagagtgacaatagaaataaatgtttggtttcttgtga

SEQ ID NO: 13854 - DNA, 2041 bp, Homo sapiens
cattgaatcggccctaacgattctcggatcgtcattatttgtaaccatagagcatgaattacctcttgaggtcatcagcgagaatttacgactggtcaacaaaagcacgtgattccctaacgccccccaccccccttccaaccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcaaatattcccctggatgaggaagcttcacatcagccatgatatgaccgggccggacgggaaaagggcccggaccgcgtatacccgctaccagaccctggagctggaaaaggagttccacttcaaccgctacctgacccggcgacggcgcatcgagatcgcccacgcactctgcctgtccgagcgccagatcaagatctggttccagaaccggcgcatgaagtggaagaaggacaacaaattgaaaagtatgagcctggctacagctggcagcgccttccagccctgagcccgcccagaggagcccagcggcccaagagcccgtgccacccccagccctggcccctccaatcctccccgctctgccgccgcccgctggggaccggttcccacaagcctgcctcgccttgtgttacgatatttcgtttggtcttaggtcttcctgtggctccctctctcctggactggttatcttgttattattgttaataataattattattattattttccttccatgctcccaactcccttctgcttgtcccaaatccgccagtgtttctgaatgtttgtgtctgtggttgcagtctttcccccaggaaaaaaaaaaaaagaaattcgcatgtttaatgtgaactctcccctccccatctgtgttctaacttatttataaaaagatgatcgctgtattttgagtttcagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagtgcaaaatgtcttgtgtatttctctgtgaatccatgggtctggctagagggcccaaagcttgtaaatatggggatagtctgggtcagacccatctctcccttacccatcttgcttccaagaccatttgtagtgagcgagtggatgctgtgctacgtgtgaaatctgtctttgcggggcctgtctcagtgattcgcttttggtatttgtttgtagctttcctggaagtcaaataaatgtttcccccactcca

SEQ ID NO: 13855 - DNA, 1660 bp, Homo sapiens
caccacacctaggtcggagcactgtcgtccttcagggctccagcctcttgatatttttgtacttcagtatcagctcgatagagcaaaagagagagaggacgagagagggggtcagagaaggggaagcaacggctctcacgttgggacaatattatctggaagctgaagaagaaactgaatactccttccttcctccccacccattcctttaaatccggagggggaaaaaatcccaaggtctgcaaaggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactc

SEQ ID NO: 13856 - DNA, 3434 bp, Homo sapiens
taatgcagcattcttttggacaccacacctaggtcggagcactgtcgtccttcagggctccagcctcttgatatttttgtacttcagtatcagctcgatagagcaaaagagagagaggacgagagaggggggtgaggagaaaagagagagagcgcgagagggagagggagagaaggaggggtgggaattacacaaagagagaaccaaaaataattttgattcctaagttaatttgctcactgatctgggattttagtcaccatggagggtaaatggacaatctgcccaggactgcagcccgatactatttttcaaagccagaacttactccattttctatgcaaatgtcagaaaaatgaaacaccctctctcccaagtcagagaaggggaagcaacggctctcacgttgggacaatattatctggaagctgaagaagaaactgaatactccttccttcctccccacccattcctttaaatccggagggggaaaaaatcccaaggtctgcaaagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactgaaaaatggggccactgggtatctctcaccctgcagctgaaggctccaggtgccccttcccacctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgagggacctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataat

SEQ ID NO: 13857 - DNA, 1367 bp, Homo sapiens
ctttttggtgtaaatctggactctaattctgtaatatatcaaggaatctcgtaaaaccgacactaaaacgtccctgcctacaaatcatccggccaaattatgagttcattgtattatgcgaatactttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaacaga

SEQ ID NO: 13858 - DNA, 475 bp, Homo sapiens
gcggccgctggctccgcaccttccgacggccgcgcactgccggcaccgccgccgcccaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagttta

SEQ ID NO: 13859 - DNA, 3437 bp, Homo sapiens
gctctctcctcactccctggcgctctctcgctctagctctctctctcgctcgctctctctcgctctcaccctcgctctgcgttctgtccgggaggagtacgaagaagccaataggatgcggggtctctaatggatgcaaatgatcatgaaaagacagtgcaaaatatgaaacaactcatttgcagggaagtaaatcaccgaaaactgtttatgaactggcatcccttcttcgaaatgtaaagcgaggacctctttaagtggtggtatatttttgtttggggggtggggggtggggggagggcgagcgagccgcggctgccatgcaagcttagacttttggaggcttctctgtccttttctattcctggaaaccacaaaaagtgtgtcggcttcgagatcttcttcgccttttctttcttttctttttttccctcctctctttccctctcctttcctggcgagggtgactaggagccggcgaatccgcgtttttttctctctctccctccctttccccctccccaccccctccccaacagcccccaactatagcctccgccgccgccgccgcctcaaaattcaataaaatgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgcgcctgctgaggctaggctgcagagaggagggggcgggggctggaggcaggtggtgcgagtccctcggcccaggggcgctgggggtgagggaggcggctgagcctgattggaggagagaaaaacgagggaggggagccaagagaaaccccctcctctcgcgttccgaggctgcccggccagggaggccagggcgcccaggccacgctggagacctgcggctgggctggtggctgtgtcccccgccacctccctctttgttttgctgtgtgtcctcccaagatgtgtgtcgggaggtggggtggggggcaggcataaaggtggagtgcaggcctgctgagcatactttttttccctcggactgttgttgttgggggagcaggaggagaagggagaccgctcttccctgcctctccctctcagggacttggccaccttcgctctgttctgaggccatggctctctgccttccttccttcgctgcctctgcttctctggtagtcacgctccactgaggcatccgcctccgggaaccgggagagcagcgcgcccgggccaacctccacccttcctttctctccccaccctcccaaccccctttttcttttactttcaaacctttttttttctttttctttctttctttctttttttttttgccaccagaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccacccacccagttgcgtgcattcaatccctgcgtttgtctctcgctcggtaacgggctgaagaggatgggtggagggtgacacggatcgccccgaggttatttattttcccttccactcaatctcttcctccccaaatctcgcctgcaagcggcctccagcccgcgggagtcggcagcggcccttgagcccccagccccaatccacagggctcggctttcccattcattattgatcatattttataaatccaacgccacacaattttttccacattaccgggagccgtggggagacggc

SEQ ID NO: 13860 - DNA, 2705 bp, Homo sapiens
aatcattttgcaaggagagctgagacgggctgctccactgtactttgttggctgagaagttgagcagggggtgggggtgggagggtggggggctgggggggtcgcgtccgaaagccctcacaccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaa

SEQ ID NO: 13861 - DNA, 2516 bp, Homo sapiens
acaccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctag

SEQ ID NO: 13862 - DNA, 1936 bp, Homo sapiens
tcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaagccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 13863 - DNA, 3261 bp, Homo sapiens
gtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccaacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctctaccccgccccaccttgcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaatattatgattttatttgacccttttattaacccctctcctcttaaaatcctccatgctcccatggcagcggcggaggaggaggaggcaggcaggcagagcccagcgggtgaggacaggcaggcagaggtgagataggccggtgctagccggcctggagctcctctccgctggcagggccaagagtatggccgtagtctcctcacattctcaagctgaggacattccatagctactctgaagctctcctttctcacgtgcagctcgagctgtgtccaaacgcccagcaacggctttctgtttaagtacacgtttgttgtggagttaattgtaaccatcatcgaatttaaatttataggaatttttttggctccaccgcccttctgccagatgtctccgtctgtcgcagttaaatgtgtagtgtggaggttagggcttttttttttttttctctaggagaaatctgtattggaatttttatacactgtttttaaggaaggaggggacagaaggagaaaccagccccctccctctcctctccacagctcctgggggtgggaaggtggggcctggctgctttccctctggcacaaatggccaggctcttccagacacaacaagacgcctatactggggccaccctgatgtttatacattgggtgtcccacagtagaaagccccagaggtttgttttgtaggggttggcactggggatggagatgacctgcggggacagtcaccatacccatctatatttgctgcatgtttcttctgtataaagataatcatggcccttgcagtgctttcagtgagggcacttcgttggtctctgtttcaaattcgttatttgggggcagaggttcaggacaactcatctcatctttccctcctctttctgtctttgtataattcaaagaaaatatttttgtcaatacaattctgttggatgaaaggaaaaagcatcatgactatcaaatctaggttctgtcatttttgatggtaggaatccctgcagcttaggtatctaaatttctaatttgtaaacgtgggtcgggtcgtgagacaagatttgcaaactagggtgtatatgcagcccacaattccctcatgtgcccacacacaaacgttttatttaactcggtgtgcctatgggtgcacataagaaggaatattatttatatgcttttgtctgttgcatggagtaaacctgaccacatacacatcta

SEQ ID NO: 13864 - DNA, 1041 bp, Homo sapiens
cgtgagtggggcggccaatgggtgactggtgcagatttaactatgtttaatgtcagatagcaataaagtagaagctgccggtcgggccccgcggaaatgggcgagcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttactaccgcgagccgtgcgccgagggtggcggcgggggcctgaagcgtgaggagcgcgggcgcgacccgggagccgggcccggggcagcgctgctcccgctggagccgtcggggccgcctgcgctcggcttcaagtacgactacgcggcgggcggcggcggtggcgacggcggcggcggcgcaggacctccgcacgacccgccctcctgccagtcgctggaatccgactccagttcgtccctgctcaacgagggcaacaagggcgccggcgcaggcgaccccggcagcttggtatcgccgttgaaccccggcggcgggctctcggccagcggcgcgccctggtacccgatcaacagccgctctcggaagaagcgcaagccctattcgaagttgcaactggcagagctggagggcgagtttctggtcaacgagttcatcacacgccagcgccggagggaactctcagaccgcttgaatcttagtgaccagcaggtcaagatctggtttcagaaccggagaatgaaaaagaaaagacttctgttgagggagcaagctctctccttcttttaaggtgcaggacacgggcgccagccccagactgagcctgtccctggcagagagcaaaagagggcgccgcctagaacacagtccccacttagaacgcca

SEQ ID NO: 13865 - DNA, 2437 bp, Homo sapiens
agggaatgtagggagggaggtggaagcactaggaggaggggaggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctagatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttga

SEQ ID NO: 13866 - DNA, 1524 bp, Homo sapiens
acctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgcgggggctcaacccccagacctccagaaatgacgtcagaatcatttgcatcccgctgcctctacctgcctggtccagctgggaccctgcctcgccggccgcatggccagagggttggaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctct

SEQ ID NO: 13867 - DNA, 1666 bp, Homo sapiens
agaaaaacgacaaagcgagaaaaattattttccactccagaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaatgccccgtgatcaataataaaccagtggatgtgaattagtttta

SEQ ID NO: 13868 - DNA, 1805 bp, Homo sapiens
ggttgggctttgccaacatatcgagatgcttttcgccggcttccatcactaacctcccggaggtcatcaagccaaatttatgagtggccgctcgagtcacgtgactctatttaaggctcccttatttgggaagagcgcataggataaagaaagagatatctccacctataaattgtccactttggagaacaaaaaacccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacgagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggact

SEQ ID NO: 13869 - DNA, 1733 bp, Homo sapiens
ttcctgacatctggcttgcgattggctgggagggggtcagctgactttgtcattttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaacttta

SEQ ID NO: 13870 - DNA, 2943 bp, Homo sapiens
acattgaatcaggaaatttttctgagaaaggcaggtgggtatgggcaatctgacacgatccaaaaggcttactgccttgcacccctccccgcaaaaaggaagtagagaccaagatcttgggctttaattttatttttaattgtaaaaagatttcaaataagccaccatttgaactgggaagggaaactagggatggtcttgggggaaaatgtcattctctctaagaaagggaccccggggatgtgggtcgttttgagggtcctagaagttgaccccaattctcacctctcctgctgcactgcaggattgcccagggtaggtctagtcccctaggttcttcagaccactccaggtcaggtttggttgggtggctgccagtggtcttccactactgttcctgtctagggtggagtaggagctttcaggggtacggcatagaggggatgttgttctcttactaaaaaaaaaaaaaaaaaaaaaaggtaggggtagggaggcaccctttcaatccctgcaattcaccagccatcactgcctcaaggccacaaatctttgcaaagctttgaattccgcctgatccaaccttaatgcccccatttattaaggacaatatttaaaactcggcaagccaggagaggcaaccgaccctcagtgcttgaagctttctttcgcctgggcgtccgccctcagctctttctgcgctcgcctgcagcagcctggcccgtggggagtgggcggtgggtgggggtaggggtggggtgggggtccggggatgctccctctatgagagaattgggtaaacatggcgaccgcggcgcccatttgcacacgctacacaaatgcatcgcattcccggttgtttgcagaaaatttacagctgagtaataaaagtttacgatcgactcacaagttggattggccacaagaagtcatgtggattccatccatgaacgtgaactttttattgtggtttgtccgttccgagcgctccgcagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaat

SEQ ID NO: 13871 - DNA, 538 bp, Homo sapiens
cggatctgattgcctggggtgctgggctgggcgcaccccactgctgctgggggtcaccccaagagccccccacccatccaaggaaaggaataaacttaaccgctggaggggcatgaggagctcagcccccccaacctcgacagcagctaacagaaacgccaggagcagcaggaggaggaggcagcgacaaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtgg

SEQ ID NO: 13872 - DNA, 358 bp, Homo sapiens
aagcgggattggaccaaaccagagggacagagtcttctgggtctctctgcctgaggccctggagggagagaaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtgtgtgttttgtgcccggatctttaggggtcggctacggagcggaccggaggcgcggccgc

SEQ ID NO: 13873 - DNA, 3371 bp, Homo sapiens
gctcgccgcccgccgccgccgccgcccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctcatgtttccatggatgagaccccacgctccggggaggcgcagtggacggcaaacttacagccggtatcagaccttggaactagaaaaggagtttctctttaatccttatttgacacgaaaacgtcggattgaagtctctcatgccctgggactgaccgagagacaagtgaagatctggttccagaaccgaaggatgaagtggaaaaaggagaacaacaaggataaactgccgggagcccgagatgaggagaaggtggaggaagaaggaaatgaggaagaggagaaagaagaggaggaaaaggaagaaaacaaggactaagcaaaaaagaaagacccccccccccttagcaactcccttgaagtttcgttttatggtagcagataaattgagaagtttacgactgtcatttgcttttatagagaatagaatgacactcacaactctaactacctgtcagatacttgcagctctggttttattacctttggacttcccccactctttatttgtttgggggctggaggggggagacggagaaacagtgaaaagttcggactctctgtctcactccttgccccacacacacttgtccctgcccccacccttctgagtccttcctggattttaaggtctgagacctggcctccgtgctcctcggtctgtctctcaccacactcccacctccctgcttctctggtatttattttagaggggagccccctcgaaatgcagaaaaggacttgtggttttgtttttatgctaaggctagtgtactagatgtactttttctaaaaaggaaaggacagaaaaaaatgaagaaaggaaaggaagacaaatgtaaagaaataaggaaaaaagcaaggaatatcccctccccctccccctccccctccccagggctccctgcttagaaaaacccccttgactttctctaggaacctgatggaaacctgaaggagatgtgggtctttcccctccccccatttccagaagggtagataggagcctgcagtcgcctctaaaatcctacctaaccatcccatggtcactcgggcccatgccttcctctccttcgctgtttgatttctattctgttgggcccgccttcctctgagctgcattagtgttagtgctcagaaatcaccataatcacgaaaataataataataaatctttaacatactacctaaagggaacctgcaataatcttgaaaaagaaaaagagaaaaattttaaaatcctgctataggagaaaaaaagagaaaaaaataaaaatcaaaaaaaaaaaaaagaaagaaagaaacctccagcgtattttatcactacctatagaaagaaatcctgctttgagagtatttgtaatgcggttttgttgtcgtttgttgctgcttatttcactaagaaaacccaacaactgagactgcctagcccgccggtcctgtgcgcttttattgtgcttctaaccccagtagagtagaactaaattgcactgaatgtatagttaactctgtcttgaattctctgtttatgcaatgtgctcgaaagaaaaaaatgttaaaaatatatctataataataattttttgtcatttgtctttatgtccagctatgaatgtagattttgtgtcccgacagccctgttcctggtccaagtactttgtattgtatacgtgagtcataataataaaaagaagaagaaaaataatagaagctggaatgacttgctttttctccacagctcttccctattctctaccttctctctccttatccccctgtccaactctctggaaaaggtctgcttcactgctctggctttggggttcagaaactcacgtggagagaagcctgggaattgagaaagcatgctggcctgggagggcaggtgaaaggggtgaggggttgagaggaggaagaaaaggagcagtccattggttgagagagtaaggagtctataggtatgcccttgggggaatcttggctccaaacaaagtgggtttccagacgccaggatcccaatgggaagaaagatttcctcactcatccaccctcctcctcctcagccttgggctgggcccagacaaagaatctgccctatgcaactatgactttttcttccagggtctggggctgaggatgagatagtgggattccttctgatctccgcatgccccttgtggccagaccttagcacccagcacccagcactagaataatgaaccgggtggggatgtgtgaggctcagggcaactggctggcctgtctgcagggcttgcctgaagatgggggatgctaagaatggagggtgaggaagcttaagcctgaaggagaggagaaaggaaggggaaagtaagtgagctcgtaggcaaccagcctgagcccacatcctgaaattcacattcaatcctctgcacaggaagattgtcatcactgtcattcagcccgcttgcatccactccaacttctgttcagacggtttaaagtccactccccacttcaccttggcaattggtcagcttacccagcccccatagtgtgggccattggcctggaggatgggcctgctgagtggacatcctgccaccccagtcacagcggggtaagagggcgtctttattggtatcttcattccccaaaatgaagaattgaaggctcagggacccagggggtagaagggtctctcacttctctctggagagtcctggacttaaaaattctgtttat

SEQ ID NO: 13874 - DNA, 1516 bp, Homo sapiens
gttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaacagccctgtgttaatatattgaagtcacttaaccagaaa

SEQ ID NO: 13875 - DNA, 1505 bp, Homo sapiens
tgcaaatttccttgcgacacatacatcacacaaaagatcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaa

SEQ ID NO: 13876 - DNA, 2028 bp, Homo sapiens
gccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgctgctctctgcttttcttacactctttaataatgattctctttctttaaagttg

SEQ ID NO: 13877 - DNA, 1702 bp, Homo sapiens
ttggagagggcagctcgggtagagagggctggcggagcggcgcagacggcggcagtcctgctcagcctctgcccggctccgtactccggccccggcctgcgccctcacctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaagacagcggtttgggttttgtggaggagacgcgttcccgggcgaattccatggagtctgcctcgagtacagattcggaaaatgtgccaggcattgagaaaatttcaggaaggagctctccgtggaacttctcctggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgc

SEQ ID NO: 13878 - DNA, 1989 bp, Homo sapiens
ctgggccggttgtctccagcgcgcactatcgcgggcgcgtagtagatgtcgctgttgtccgtgcttacccggccggccggccaggctctggagcacgtgacccgagaggaggctgcggctcaaggccattttcaaatctcattggcttggttgtcatgtggtcggcagaggcatccacaattacacggggaatgttttcctagagatgtcagcctacaaaggacacaatctctcttcttcaaattcttccccaaaatgtcctttcccaacagctctcctgctgctaatacttttttagtagattccttgatcagtgcctgcaggagtgacagtttttattccagcagcgccagcatgtacatgccaccacctagcgcagacatggggacctatggaatgcaaacctgtggactgctcccgtctctggccaaaagagaagtgaaccaccaaaatatgggtatgaatgtgcatccttatatacctcaagtagacagttggacagatccgaacagatcttgtcgaatagagcaacctgttacacagcaagtccccacttgctccttcaccaccaacattaaggaagaatccaattgctgcatgtattctgataagcgcaacaaactcatttcggccgaggtcccttcgtaccagaggctggtccctgagtcttgtcccgttgagaaccctgaggttcccgtccctggatattttagactgagtcagacctacgccaccgggaaaacccaagagtacaataatagccccgaaggcagctccactgtcatgctccagctcaaccctcgtggcgcggccaagccgcagctctccgctgcccagctgcagatggaaaagaagatgaacgagcccgtgagcggccaggagcccaccaaagtctcccaggtggagagccccgaggccaaaggcggccttcccgaagagaggagctgcctggctgaggtctccgtgtccagtcccgaagtgcaggagaaggaaagcaaagaggaaatcaagtctgatacaccaaccagcaattggctcactgcaaagagtggcagaaagaagaggtgcccttacactaagcaccaaacgctggaattagaaaaagagttcttgttcaatatgtacctcacccgcgagcgccgcctagagatcagtaagagcgttaacctcaccgacaggcaggtcaagatttggtttcaaaaccgccgaatgaaactcaagaagatgagccgagagaaccggatccgagaactgaccgccaacctcacgttttcttaggtctgaggccggtctgaggccggtcagaggccaggattggagagggggcaccgcgttccagggcccagtgctggaggactgggaaagcggaaacaaaaccttcaccgctctttgtttgttgttttgttgtattttgttttcctgctagaatgtgactttggggtcattatgttcgtgctgcaagtgatctgtaatccctatgagtatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatgacatatatatttaaaaaaaaaagattaagaaaacccacaagttggagggagggggacttaaaaagcacattacaatgtatcttttcacaaatgaatttagcagttgtccttggtgagatgggatattggcgatttatgccttgtagcctttcccttgtggtgcatctgtggtttggtagaagtacaacagcaacctgtcctttctgtgcatgttctggtcgcatgtataatgcaataaactctggaaatgagttca

SEQ ID NO: 13879 - DNA, 1939 bp, Homo sapiens
tgcaatcgatggctcaggttggctgcgcggggagcggccagaggctcgctggcgcgcacgccgcggagtcatgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggctccgcacgtccagcccgtgcgcgaagtggccttccgcgactacggcctggagcgcgccaagtggccgtaccgcggcggcggcggcggcggcagcgcggggggcggcagcagcgggggcggccccggcgggggcggcggcggcgcggggggctacgctccctactacgcggcggcggcggcggcggctgcggcggccgcggcggccgaggaggcggccatgcaacgcgagcttctcccgcccgcgggccgccggccggacgtgctcttcaaggcgcctgagccggtgtgcgctgcgccggggccgccgcacggccccgcgggcgccgcctccaacttctacagcgcggtgggccgcaatggcatcttgccacagggcttcgaccagttctacgaggcagcgcccgggcccccgttcgccgggccgcagcccccgccgccacccgcgccgccacagcccgagggcgcagccgacaagggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaaggcatgagtcactgtctttttttgtgtgaataaatggtttctagtaaaatggaggttacagcttcaatacactgtatgaattctcctctttgaggtttagtgcctccttaggatattttagtggccagaacccatgcaactgaaaatcgaatgaaatactttttagtcccactaaaatagtagtcgtaccctcccaccacctctaggttacactggttttaaaaatcatgttagtgatgaatttctgaattgacgatgtgaccaagcaatgctggcgctgccttctccaggcagtaaggctggggcagcaggaacctaagaagaaaactcccacccccaccactagtctagtgaacttgggatttctgaaaagacagcaaccatttttaaaaactggttagaaaat

SEQ ID NO: 13880 - DNA, 926 bp, Homo sapiens
atgtacctgccgggctgcgcctactatgtggccccgtctgacttcgctagcaagccttcgttcctttcccaaccgtcgtcctgccagatgactttcccctactcttccaacctggctcccggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaa

SEQ ID NO: 13881 - DNA, 1805 bp, Homo sapiens
tctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcccttttggacagaggccttgtttggggagggggatctggggctaaggctaaggcttttccttcggttccttctctgctggccccagaagccaccaagagatttacagaccaggccagttgggcctccttgctttcctcagtccctgagaagcccgtgagaaacgtgcggaagtaccagtgcaactctggctggccttaaggcttccacgttgggggactgaggccaactctccttgctcctggctggggcatttgcacccaccgctcattcttgctccccggtacctggatttttctgtttccacccaattcgttctccctttccccctctctccagccccttcagcgtatagcagtcgcctagttagggctcagagtggaaggcctcctgagggaatggaaaggactgtgggtacaattaggtctctgcagcagaagccctttgtggcaaggccaggatcttcactctggagaaaggaaagggcaccatccaccctccaccctcctgtctgccctggctgatttgagagaacaaaagccacactagatcttcagactttgggaggaaaagggagggaaggggaggggctgggtagtggggtaaacttggagatatctcgaaatgagaaatgcgaaataggctggcctatttccagctgggtagaatatgtggaaccttcatttcctgagatgggatgagagagactgggactccagacaagtgccatctccagacaagactggcaaacattgccctactcccaccttctcaaacatgcctaggccaggcctatgaaccctgtaactggatccccagaggctagctctggtgaaaggagctgttggtctgctttgaagctctgttgcacagggagagggaaaaatat

SEQ ID NO: 13882 - DNA, 4050 bp, Homo sapiens
gcctccacagatatcaaaagaaacctgaagagcctacaaaaaaaaaagagataaagacaaaattcaagaaaacacacacatacataattgtggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcggaactgtatctgtgttaatcatgcacacttgcaagcagatcactatgcctttatctcgcacaatccccatggaaggccccgaaacagactgacactttgaaaaaaatattttatttatttggagtctagtgcataaattggttctcgggatacttgattactttccagctattgaaattaggggagggggaaatgaggatgcaaacctaagaaggttctgggcgggatgatttgggcagggctttttgaaagcagcgcctgctttgctgtttttactgccttctttctagacacaatcgacttttacactggggagaccagagctcacttttctgcattaagtaacaaaaaataaactttgaaagaaaactgacaatcaaagaaaaaacacaagagaagttgtaagaagaattgagctatgaaaaagctaaggtgtagaaaaagaaaccatcatttggagacgcgtacctaagctttttctctaggaaatgctgtcatgaattcttcctttgtagtgatcattagttcatttctaaagaaaacaaacattccccaagatgtaaagtaataatatttcattaatgaaacataacaagtataaacaccttgtttactcctgtttcttatacaaaatgggcaaaaatgtcttcaaggatttataaccattttgtaaatattaatgtggcttctgctaggggtggacaacttcccggcttctatgggaggggccacttagaaaacgccttcagataaggttcaattcttttgtatttcagcaaagtcagcccacgcatctctatttggtttgacaaataatgcaactcctactacatccccgatgacacgaagtgaaattcctattgtgtggaaataatttaacttctaatcttctggtggaacaacaatcgtttctatttggatgtttgtatttcactaagtaatgatggctcaaaataatatttagtttccttgttcctttgtgctgtttttaaaatggcatgttagatttgggggtgggaggggatatccttttgctaaatttcactttatctgagcaggtttaaaatatatatgttgtagaagtgtatcaacagaataaatgacttcaatcgaaggcacattttacccactttcaaggcttaacattgttttctatgaaatttgcatccataggcagaatttctaattgtcttgtaagaaattattttttaagctattagagaaatcaaaggagagctcactgccttgcagggattacaaccacctttcttaactggctaaatattaactagctgaattgtcaggctgcttagattcagcccgattttccctcatctcctcttcctaccataaataataataaaaatacgtaatgtgtcatggctccaggcgttttccagcacagtgtgttaccgcaggagtatctgctgagtctgcgggtgtctgcaaagccccaagtgtcatttgcggcttagggtttcatggattagactttaaacggtgtctagcccggctgacattagcttcctctcacactcaggctccaaggaagtgtgggatcaggggctccctctccaggcagccacagctttccccgacgccctcctctcgagtggggtgagggcttggaccaaatctgccaccttctgtcatctctggaggttcccgagacttctaatagctcggatctgttcctgccattggcgtgagactcatctgaggggcgtgggtgggggtgggcggcgagccg

SEQ ID NO: 13883 - DNA, 2384 bp, Homo sapiens
agttgaacctcagcctggttccgttctaccgggaattccgtgtgctcgagtatatggccgtgtctgcgagcgcgcaagaccagggttgggacagtgttgtctgcagacaaagggggaaggctagctctgccccccactggcgcccactctgaggccgaggacaccaggtttatgataaattgggatccaggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaa

SEQ ID NO: 13884 - DNA, 428 bp, Homo sapiens
agacgcccggaccgaccgccgcctgtagctcggcagccttcgggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtg

SEQ ID NO: 13885 - DNA, 4217 bp, Homo sapiens
ggtcgatgcaaaaacttcacgtttcttcggaatagccagagaccaaagtgcgacatggagactagaagcagccggcgctggtcagccgcctcgttctgttttattaccttggactccaggaggatcagctgcgcctggtgacatagagcagcttttcctctccagaagctcctcacctttaaacagagtatcctctgggtgctgaaaagaaagaaagacagaaagagagaaagagagagagagagagaaagagagaatgcaagcctaattggttgcatggatgcagggccaaagggctaggttttggggtactagggagtgaggtacaaggccagcttgcccagtcccagctctgccctccaggaacatgaggtgcaaaggtacccaaatgggggcttgcttgtatttggggcctgtgggaagaaagcaagcttcaaagaagcccagtggggagctctagggtgcattttgacaaggtggaggtgcccttgccaccatcccagcccacccccagctacatgggcaagggcagcgagggccccctgctattttggcagggcccagctttggctgggaacccccgggcctgggcactggtagaaagcatggcggttactcattgcctaatttgattcaagctggccagattctggtaacttttgggtgaccctgatgaagacaaagccaggacggcggcctttgtatggcagaatccctgctcccgccggctgcaggcagggcgggcaggcaggaaccctcctcgcctggggcactctgcccaactcagaggcgagttcacccacccacctttcattgctctgtaccccaataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcgggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcggaa

SEQ ID NO: 13886 - DNA, 1464 bp, Homo sapiens
ataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcggtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatca

SEQ ID NO: 13887 - DNA, 2583 bp, Homo sapiens
tccgtgcagtgctgtggtgcgaaaatgcctcgccggtgcgcaccgggtcggcagcctcggcggcgggggcgagattggcgggaggggggcgcggggggggcgcggtaagaggtggcggcgggcagagggtgttttttttcttttccctccagagccggggtttgtaaaccgaggccagagtgtccccgtgggccgagcgcacttttttcttgtccgggtgcgctcagtcactggtgcctgagaggaaacagtggaggcagcggggcaggtcgcctggggcgtcggcgattatattgcggccgagccggggcgcgccgggaaaggccgggagggcggcggcgcgcgggggctgggcgaggccccgcgacccgcgagggaggcggcgcgaagccgaggcggcgggcgcaagagccgggcatgagcgcccagtagctgagcgcccgcggctgcctggcctcagaagcgacgcgcgagcgcgggcgggcggcagcagcgacgtagcccggcggtcccggcggcgagagcagccgccccacaggcccccgcggcagtgcggccgagtcgaggctcgctctctggctgcttagcgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctgga

SEQ ID NO: 13888 - DNA, 1268 bp, Homo sapiens
tgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaa

SEQ ID NO: 13889 - DNA, 1932 bp, Homo sapiens
gccagagtgtccccgtgggccgagcgcacttttttcttgtccgggtgcgctcagtcactggtgcctgagaggaaacagtggaggcagcggggcaggtcgcctggggcgtcggcgattatattgcggccgagccggggcgcgccgggaaaggccgggagggcggcggcgcgcgggggctgggcgaggccccgcgacccgcgagggaggcggcgcgaagccgaggcggcgggcgcaagagccgggcatgagcgcccagtagctgagcgcccgcggctgcctggcctcagaagcgacgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggc

SEQ ID NO: 13890 - DNA, 1560 bp, Homo sapiens
cgcgcggatccctccgcggggctcctcgtccccgtcacgctgactttccgtgcagtgctgtggtgcgaaaatgcctcgccgagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaac

SEQ ID NO: 13891 - DNA, 2418 bp, Homo sapiens
gcggccgctccgtgtgccctggactcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtgg

SEQ ID NO: 13892 - DNA, 2757 bp, Homo sapiens
cttcagcctgtttatgagagtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccaggtaatttggggccaggacagggcaggaacctctccctggagagtggttttcctgcttttctgctgctagaaatgttgctgtatgggagctag

SEQ ID NO: 13893 - DNA, 15049 bp, Homo sapiens
ctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcacacaaacaatgcaaacggggcaggggcgggggggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaagaaaaaggaaaaaaaaaaagtcaataacaaaaaacccagctcaagaacccattctacgccaaactggaaaggagaagagagcaacaggaagattccagaaacggggggccccagtttttgaagaactttatgaacttttcaaagattattttcatatggcagcaagtgatacggaagactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggccaggctgctggaaggcccccgggggcgcggggcgagttttctttttctgagcactctggataaatccctaagcaacgttgtttctcaaatgtcattaataatgtgtgttgcaaactttaggtttttttcttttctgaaaatgtattttctctttgaatccacccctagtcgcgtagcgtagggctagcggtcgtcacagacaccctagtagaatgtagcactcagcacccttgtctcctaccttgtgttcaactccaatgataccaatagaatattcctcaatgtaattgcacaaaaaaaagcgatataacataggcatgtaaccaatgtggcggtgcaggtgtgcgggtgagcgagcacgtgtgggtgtgcacgcgccgccctccccgcgtggccctcggcgccgccaccctagctggcgcagtcttgacactgcatccttccctcctagtgccttaccgagcgacagacgcggcgtgagggtttacttccactggtactccaagaaactgaggctagtcagacacaatctcagctcttctgttgtgctgttgtaacagtttacgctggccttttttttttctttttctttttctttttaaaatgttaatgcccgttgtctttcctgggctgtttgctagcggaaggatgccagggaagccagcaggagctaggagagagtccgtggatctcgaaagaaatatgggagacagatgcccggcgggtgcgtctggagatggggacggcgggagttgagttgtggcagtagttgagttgtaatttgtgggcggaggcccagagagactccccacccttcacccctgccccactctgtccccagttccgccatttgtgaggccagaggtttccggactgttggcctcgccaggcagccgtctcccgccccaggcggcatcccccagtccctcccgcctccacgagagcctggagctctcagcctcgcccggggctccactctctcctccggctccctgggctgttttgctctaacgatcttgccagatccctccctctgtagacaaccaccaacctctgtttgctgttgaattctctcctcacattacccaggtctgctcaagacatgattttggttttggtttctgagggttctagtgggcagaaggttggagggacacttatgagggtggccgggggtctgacgctgcactttggaaaaactcacacagttgaatttccaaagaaatctgccctttgccctctttgcacctttgatacattctggaagttttctcaggctttggacacttctggggatggaggtgtggagaagtggggagttccctctcttcatagtaaataactctgaaatatgtgaatgtgaatggcaggagaatctggccaaggatggggccgaaaagggtggttctaattgtttgcttctgatgttgagtctttagctgaccccacaggcaggtttccaaggtgcaaagagatctttcccgagtcagcggccccatcctcatcctccctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtcaccttagcaaataggctgctgtcactaggaccaagctctcaagcagagggatgccaacctagtccttacttagcccacgaatcatctagagcatcctctagtcttttgtgggctccctccttcccatttgaagagacattgttcagaggaagaggggaagatttgaaatgtcaggtcacggaggagtgtttaactggagcctggtgaaccgcagggcaatttgcttctgctcactgggttctgactggcccgtctggacgtgggcccccatgtctctgtgcttagggcctcttcatgatgttttggatgtttccaagggaagtgggtgagcagatcaaggggtgggagagtcgaggcttgatgccagttaatactgtgaagtggagcgtgcggtcagtggaattcagaggaaaaagaagggttggagcaaagcggcattcatctcctggactgttagcctttctagtcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcatgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagattttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctgtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 13894 - DNA, 3969 bp, Homo sapiens
cacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcacacaaacaatgcaaacggggcaggggcgggggggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaa

SEQ ID NO: 13895 - DNA, 7408 bp, Homo sapiens
cctcgccctagccaagccgtccccaccccaaatccccgggaaggaagatgagggagacgggcccggcgcttagcagccagagcagcagcagcagcagcagcggtcgggggagggtgtttcgccgtttcctctcagccgccaggacaagatggcagcggccgcggagaggggctgagcccgggctgggtggtgccgcctgctgaagcgcctggctcccggtccccggcacggccctgcgccccaccccggacatgctcagggctgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacagaggtattttggtaaaactaatggaatgggagccaggaagagaggaaataaatgctttcagttggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgttttttttttcctccagcgtgtttaattaaatatgttactgtattagcaaaacattttcatttttaaaatctgctaattttaaacttggactgtgttaagtaaaagttaaatcatacactgcaaggtgtaggaagatttgttttaatgaatccaatgatacagatttgattactaagtttgaactgttaattgtttaacaattttagacttgtggctttctttctttggtttatttgtttttgcttttactcctatgctacactagtttgccatgtagcaattgcactgtgcaatattacaataaggactgggaaaattttatggatgtaatgtctattacggtttgcgatagtatttctctctagttctcagtgatttaaatgtgaccaagccttctgtactttgtcacaaaaagcgggttttccaggtgactattttggtgagtgtcaaaataagaatttatggtgtattactgtcgattcactttgaattaaaatatatatattgcagcaaa

SEQ ID NO: 13896 - DNA, 7345 bp, Homo sapiens
cctcgccctagccaagccgtccccaccccaaatccccgggaaggaagatgagggagacgggcccggcgcttagcagccagagcagcagcagcagcagcagcggtcgggggagggtgtttcgccgtttcctctcagccgccaggacaagatggcagcggccgcggagaggggctgagcccgggctgggtggtgccgcctgctgaagcgcctggctcccggtccccggcacggccctgcgccccaccccggacatgctcagggctgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgttttttttttcctccagcgtgtttaattaaatatgttactgtattagcaaaacattttcatttttaaaatctgctaattttaaacttggactgtgttaagtaaaagttaaatcatacactgcaaggtgtaggaagatttgttttaatgaatccaatgatacagatttgattactaagtttgaactgttaattgtttaacaattttagacttgtggctttctttctttggtttatttgtttttgcttttactcctatgctacactagtttgccatgtagcaattgcactgtgcaatattacaataaggactgggaaaattttatggatgtaatgtctattacggtttgcgatagtatttctctctagttctcagtgatttaaatgtgaccaagccttctgtactttgtcacaaaaagcgggttttccaggtgactattttggtgagtgtcaaaataagaatttatggtgtattactgtcgattcactttgaattaaaatatatatattgcagcaaa

SEQ ID NO: 13897 - DNA, 4478 bp, Homo sapiens
ttcattaaggggaacaaacaaacgcgcaggcacgcagcttgagcaccccagccgatggccgcgtcccgggctttgtggccccgtccccagcgtcgcggagcagcgggtttgcagggtgtcaactctggggacgtgcgtgcgtgtgtgtgattgttggggaggagaaatgtgatccgcggctccgcgtccccagcggcggcgggaggaaggcgtggcggccgcgcggcggggctgttgccggcttctctcgttacggtggctgccgcccgcttcccttcgccgcactgggagaactggcggaaagactttggatgaaaatgtctgtttctctgtcgggagggagacggctgttgtaaaatggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgta

SEQ ID NO: 13898 - DNA, 3668 bp, Homo sapiens
gatttcctaatctccaggaggaaagaaactagtctttgggagttaaaccgactaatttaacggagaattaccaatgtggaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtga

SEQ ID NO: 13899 - DNA, 591 bp, Homo sapiens
ttcattaaggggaacaaacaaacgcgcaggcacgcagcttgagcaccccagccgatggccgcgtcccgggctttgtggccccgtccccagcgtcgcggagcagcgggtttgcagggtgtcaactctggggacgtgcgtgcgtgtgtgtgattgttggggaggagaaatgtgatccgcggctccgcgtccccagcggcggcgggaggaaggcgtggcggccgcgcggcggggctgttgccggcttctctcgttacggtggctgccgcccgcttcccttcgccgcactgggagaactggcggaaagactttggatgaaaatgtctgtttctctgtcgggagggagacggctgttgtaaaatggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaactttt

SEQ ID NO: 13900 - DNA, 2451 bp, Homo sapiens
agagccactcaacagcgctggaacccattcggtggggcctggggcccctcatcccaagccaggagggtttctggggaggggtgcagcccctggcagactgacagtgtggcctgggggtttgggggtgccagggaagcaggggccaacctcataggaggagacacgagtgcggttctctttcccccactggggggcctgctgtgtcagcagccaggcgggaggcctgggcggcagagccagtggtacaggggcctgggcagggcggtgtctggcagcagcggcaccatgtccaccatccagtcggagactgactgctacgacatcatcgaggtcttgggcaaggggaccttcggggaggtagccaagggctggcggcggagcacgggcgagatggtggccatcaagatcctcaagaatgacgcctaccgcaaccgcatcatcaagaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcaacccccaccctgacgctgccaacccctggcagctcaagtcctcggctgactacctggccgagacgaaggtgcgcccattggagcgccgcaagtatatgctcaagtcgttggaccagattgagacagtgaatggtggcagtgtggccagtcggctaaccttccctgaccgggaggcgctggcggagcacgccgacctcaagagcatggtggagctgatcaagcgcatgctgacctgggagtcacacgaacgcatcagccccagtgctgccctgcgccaccccttcgtgtccatgcagcagctgcgcagtgcccacgagaccacccactactaccagctctcgctgcgcagctaccgcctctcgctgcaagtggaggggaagccccccacgcccgtcgtggccgcagaagatgggaccccctactactgtctggctgaggagaaggaggctgcgggtatgggcagtgtggccggcagcagccccttcttccgagaggagaaggcaccaggtatgcaaagagccatcgaccagctggatgacctgagtctgcaggaggctgggcatgggctgtggggtgagacctgcaccaatgcggtctccgacatgatggtccccctcaaggcagccatcactggccaccatgtgcccgactcgggccctgagcccatcctggccttctacagcagccgcctggcaggccgccacaaggcccgcaagccacctgcgggttccaagtccgactccaacttcagcaacctcattcggctgagccaggtctcgcctgaggatgacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaattattcttacagaaagatagttatccagaaattctcattccccgtctgcggtgcggtgcgtgcctgcacacctctcctaaacacagcagggctttggagtctggcccatgctccttggccagaaggacagcaggaaagggggctgcaccccgctggccctgcgctcgcccttggccctgctgcctctgtctatttcaatatagaactgttcagc

SEQ ID NO: 13901 - DNA, 2027 bp, Homo sapiens
aacagcgctggaacccattcggtggggcctggggcccctcatcccaagccaggagggtttctggggaggggtgcagcccctggcagactgacagtgtggcctgggggtttgggggtgccagggaagcaggggaccttcggggaggtagccaagggctggcggcggagcacgggcgagatggtggccatcaagatcctcaagaatgacgcctaccgcaaccgcatcatcaagaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcaacccccaccctgacgctgccaacccctggcagctcaagtcctcggctgactacctggccgagacgaaggtgcgcccattggagcgccgcaagtatatgctcaagtcgttggaccagattgagacagtgaatggtggcagtgtggccagtcggctaaccttccctgaccgggaggcgctggcggagcacgccgacctcaagagcatggtggagctgatcaagcgcatgctgacctgggagtcacacgaacgcatcagccccagtgctgccctgcgccaccccttcgtgtccatgcagcagctgcgcagtgcccacgagaccacccactactaccagctctcgctgcgcagctaccgcctctcgctgcaagtggaggggaagccccccacgcccgtcgtggccgcagaagatgggaccccctactactgtctggctgaggagaaggaggctgcgggtatgggcagtgtggccggcagcagccccttcttccgagaggagaaggcaccaggtatgcaaagagccatcgaccagctggatgacctgagtctgcaggaggctgggcatgggctgtggggtgagacctgcaccaatgcggtctccgacatgatggtccccctcaaggcagccatcactggccaccatgtgcccgactcgggccctgagcccatcctggccttctacagcagccgcctggcaggccgccacaaggcccgcaagccacctgcgggttccaagtccgactccaacttcagcaacctcattcggctgagccaggtctcgcctgaggatgacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaatta

SEQ ID NO: 13902 - DNA, 774 bp, Homo sapiens
gcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaagtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 13903 - DNA, 5881 bp, Homo sapiens
gcctcccgtcccttcccgcgagcagagggagggaccgccctcgctccccgttctctccgcccccttcccgccccccgcagcccactctgccgccgcgctagcttcacgccggcggcgctgaccgggaaagcagcaccctcttctctgccagccggccggccggcggaggcggaggcagcggcaggcttcaggccgccggggctggcgctgctctgcccggcggtagccggaggcgggcgctgatggaagtgtgaagaggcggcggcggggcccggggaatgtgaggcggcgcgtggcggcggcgcggagcgtgagagacgaggagtaggggtgggggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagctgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatgtgggctacagtctcccatgtttttatttaactgaagcatatacacttcggtcatttatctccttgtggtcctgattttgtcagtactggaatgggaggcaggtcggggaaagtttgtttgatggcagtggattcttattgttgttttaaccattgcattt

SEQ ID NO: 13904 - DNA, 815 bp, Homo sapiens
gcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacataggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 13905 - DNA, 642 bp, Homo sapiens
gcaagttttcattgggcaaaatgggttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 13906 - DNA, 1990 bp, Homo sapiens
gcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagaatctgggcgtgaaaccccatcttctactcaggcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaa

SEQ ID NO: 13907 - DNA, 1782 bp, Homo sapiens
cgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaatgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaatt

SEQ ID NO: 13908 - DNA, 1815 bp, Homo sapiens
cgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagaatctgggcgtgaaaccccatcttctactcaggcatccagtgtcaacgggacggacgatgaaaaggcctctcacgccggtccagccaacacacacctgaagtctgagaatgacaagctgaagattgccttgacgcagagcgcagccaacgtgaagaatgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaatt

SEQ ID NO: 13909 - DNA, 1950 bp, Homo sapiens
cgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaa

SEQ ID NO: 13910 - DNA, 6201 bp, Homo sapiens
caccgataactagggctggccgaggcccaggccccgccctggccctggagcaacctggacggtgttcccttgagctggtgtgacgtgccctcgtttattctgacatccagcccagtctcagtactgttgtcataaccttacgccagactcaggcagaatgtaagccattcactcgtgagcatcgcagccgcttgtgctgcctggaagctgcagggccaggactgcattttcagtttgcaattgaggtctcctgattttggtgtttccaagactggctgctataccttgataagctttccttctgcctccatgaaacctggtgtctaaaaaagatcaactaaaacttggaaccctttaaccaagaggacctttaaaaataacctttcattccagtcaagacccagctggatgcattttaaagttgggagtggcgaggaagccttcctagtgccgcccggggaatgtaaaaccaccagagcaacaggttgggacagtatggtcaggccttggagggaaagagaaccagtatccacacaagacctcgaacttgtgtggcccctcagtttcatctctcctgcctgccatcacattagactttaattgggtgagagaacagggcagagactgtcacctgcattttgcagatgggaagtagagacagagaaagtgacacgcccagggtcacccagcggtgaccagcagcgtggactctgcatccaggtctcctggaccttgatgcagtatcttttgagacatgccactctagtccctttggtgacccgtgggtgccaagagaaaataattcttatatcctgataagagcatattacaattatattatttcaatatgtgtccacagcaaaggacagtttacaaaaatgtgaatccgaatgacatttaggaatgtttgttataaatgataagttccactttggaatgattctggttttgcaggaatctttccaagaaagttggttaaaatgatgtctctgcctgtgaggccagttctatggaaaacaaacacaccctgagttctttattgatggctttagtggaggcagagcagtatgttcaaaacaagtgggaggccctgagatcgcaggaatggaaacagagttctggctgggggtggcctgtccactgcccgccccttcctggagatgcactcctttctggctttctggggagggagcagccttgctcagtggtgggagcagcttgaacgggacctgatcaacacccaggaagactgtgcacagagggcagttggtctccagcctgcaggctccatgagcacagccttgatggtggtgggcaggcgcctgcctgctgtggactacatttgatgcaaaacatcaagtaaagggtggagcgtaatacagtgaatatgcctcccagaaacatcatgctctgcctattttaacagggctctttttctttagaaaagtctccttctctatagaaaccagggacaattttggatgagagccaaccacaggacgcgctggggacgttatggtgggacctcacatgtggccaggtgcacctttgggaagaaggcagacgtgatgtgacttagcacaggcactcaaaagaggcagccactggtctttgctaatatccagaagtggattgtttgttccattcatccttctagaagctaaattctttcattgccttgagacatcactagattttgaagcacttgcaaactagaagcttgcaagatcaatgtccatgtatatttttaaagatatgcatgctttaaaaggaccctaatttctgagtacatggcttccccaaagaaacagtatatattctggagatgatgggggttttggcatggagagggactcctgtctagtctagaaaatgttacttacatgcctcttccatgtaccgatctcaagaatatgggttttctagttggctttaaacactacccaggcaggaaggtggctttggtaagaattttgagctggatgaaatgttctagtgaacttacgactgtgtatgtgcgcacgcgtgtgtgtgtgtgtgtgtgtgtgtgtgtgtgtgtgtgtgtgtgaagaaacagcaaaaggggaagtgggagaaacagtaaggaagcgtttttaattaaaaatatgtatacctaagaggagactttattttctatttctggtggtggtgatctatgttctggaatccatttaccagaagtttgtggatcttttgtttgaagtggaattgttcagtgccctactctctttgacggtgcagagccttgcggcaaagtgttctcctgggccctagagacccccagggcacctggcaggagcccgtaaaccacggcagagtcccaagtggtgcatgttttggcgagtgatgggcaggactgatgattcacagctgtgaggctgtgctattgtttttaccctcttgtactgcttttaataggaagtcccgactttacgtcagttgtgagagcagcgtcttatgatgtgacaggcaagaagacattccttgcatcaaatataagagtttaatgagaagagtggagtggataagtgaactctcccaagagtactgttttttgtttccctttttaaatgctttcttggtacataaataatataatactttttttaaagaaattccagatgagtgggaaaaaaaccaatcacctgttattacactatctgattataaccactgttaacatttcagtttttatcttttcagacttttttctatgcatctgtgtgtgttttattactttttccatgaaatataatcatattatacatactgttttataacttttatcccttttaatgctatattgtgaatagatttctatatcagtaaatatgtaattacattatttttaacctctatgtaggttgtaccttggatacttaggttgtttccaatttttttactgttgtagtcaaggacataatgaagttcttctaacatccttgcgaacttttcagaatattgacttagggtaattttctgaagttatcactggctcaaaagtacgcgcctccctatctgcggctcctttccttctgaggcatacaggacttcaccctccatcccccttgtactcattcagggtcctatgactaattctggccaatgaaatgtgagcacaggtgacacatgaagctccagacagacactgaaatgcccatgagcagttccgcagtgtctgccttcccttccctcagcaaatgctgatgtcccagggacagagcctctgtcaagcctggatccctgagtgactacgtggagcagcccccttctcccttcatgttaccctcacctgccaccctgcatggacgggtagcatgaataaaaaaaataaaccttaggtgttaaacactggggtttcagggttaattggttaactgcagcataacatatcctgttgcaacaataaaaaagaatgcacatttttaggacttgtaatatgtattgcctcaaattgccttccagaaagacagacccaattatactcccacccacagtgtgtgagtgtgtactgcttcctctttaacactggagttaccctggggacagagagctaaaaaaaatatttttttggttaaaatgtaaccctttaaggtgttcagcagtatcattgatttctaagaggtttatttcataaacattgtaaaacaaaattttaagttgcacgtatggctttttaaaaacgtttagacatttaaaaaaacaccttttagtcaagtttatctgttacttttttttttttttttaatggttgctacctatgccgtcatgcttatgcaggtctttccaattcttttttttttttttttttttttttttttttgagacggggtccaccctggcccccaggctggagtgcagtggcgtgatctcagctcactgcaacctgcgcctcccgggttcaagcgattctcatgtgtcaacctccctcctgagtagctgggactacaagtgtatgccaccacgcccaggtaactttttgtttttagtagagatgggtttcgccatgttgcctaggctggtctcgaactcctgaactcaggcaatccacacgccttggcctcccaaagtgctggaattacaggtgtgagccaccaagcccggcgaggtcttcccaattctgatggcaaggttgtataaatattcaccactatcttattcttgtacttttattatttctttctaaacagttaaatctgtgatctggctgggcgtgttggctcttgcctgtaatcccaacactttgggtcgccaaggtggaaggatcacttgagtccaggcatttgaggttacagtgagctttgatggcaccggtgcactccagcctggggaacagagcaagaccctgtctctaaaaaaaattttaaaaacctctgatctatctggaatgtattttctaaattaccccaacactgtttattgggaagtctgtcctttattctatatgaaatcccatttttgccatacacctagtagcccttctgttgggtgccaggataagcaccctggccttgagtgtgctgtgaactctttattatgggttgtgatcttcctgcacattctagcactggtaccacattgtttggatcgccatagctttggactaaacttccccattaaactttttcaaaacttgcctagtatattgtgcaggccgggcatggtggctcacgcctgtaatcccagcactttgggaggccaaggtggatggatcacctgagatcaggagttcgagaccagcctggataacatggcgaaaccccatctctactaaaaatacaaaaaaaaaaaaaaaaaaaaaaaattagctggctgtggtgataggaacctgtaatctcagctacttgggaggctgaggcagtgaacccaggaggcagaggttgcagtgagctgagatagcaccagcctgggcaacggagcgagactctgtctcaaaaaaacaaaaaacaaaacaaaaaaaaaaccttccaaaagaagtttgagataattttatgtttagaaaaattagaaattggattgagtaaaatttacatattttacacaagaggactaacatctttataatatttaacctttcagtaaatttatgttttatgtttctcagcctatcttttctagtataggtgatttttttagtgtggttactattgtaaatgagatcctactactttaaaaaatgaaaattaaatctatcgcttttatgactttaaaacattagacttatgtaagtgtaaacattatttaaaaacataatgtagaaaattaaagtcccccataattaaaatccctttcccccagaaaaagtcaacagcatattcatcagttttttcctaaagtatgttttagcactttgaccatatgagacaacccttctgctgttagcatttttctctttgcaatagatcttcctatgtcagtacacatcaatctacctcattcttacctctgcataagagagtagtgtgtagttgtataatagtttaacttggcgattggttattgattttgtaactagccagttactgaattattctaaaggttttgctgttgttaatttctttcgcctttttcagttgggtaatagttctgggtaggttgataattttattcccatatttgtaatcttatttcactttctcaactcatcacattgactggtacttttagaacaatgttaaaaaacatttacataattgtgctgatattgtacattatttgatatatatatatcaaattttttttacttagaagagtgtttctccaaaactataaatttgactcttagtgtaaaataatcttaatatttgaattatacattcaggttatgccctctatttctagtttgatgaaaatattattagtaatggatgttggggttttattaaatggcttttttccacatctgtcaagatgatcaactggcttttctctattatgactttagatgaatcgttttaatagatttgctaatgttaagacatctctgcatttctacaagaatctgatgtagtcatagtatactattcttttaatatacatctcctttcaatgttaacagtggttatttatgattggttggtccatagtagatttttattttgtgtttcttatctgtactttctgatttttctacaaagattgtgtattacttgtataataaaaataagagctttaaattgt

SEQ ID NO: 13911 - DNA, 1287 bp, Homo sapiens
gggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtggc

SEQ ID NO: 13912 - DNA, 1284 bp, Homo sapiens
acgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctga

SEQ ID NO: 13913 - DNA, 645 bp, Homo sapiens
acgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggctggggtgggccccagtcggctctggttgttggcagctttggggctgtttttgagcttctcattgtgtag

SEQ ID NO: 13914 - DNA, 1577 bp, Homo sapiens
gggaccggaggcggcgcgggcggcggcggcgcagacaaaggcacgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtggc

SEQ ID NO: 13915 - DNA, 1418 bp, Homo sapiens
ggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtggc

SEQ ID NO: 13916 - DNA, 1979 bp, Homo sapiens
caataaccaggacaatgagaaatttacatctggatgtcagcggccaccaggctcctctcagagggccatctcctgtacagggtgttgtgggggcttcccctagacaaagaaagatggggtctgcttgctctgagttatctataataattatcttacctttttgtttctttttataatttctttcttttttgagacagggtctcactctcttgtccaggctggagtgcagtggcctgaccatagctcactgcactgcagccttgacctcctgggctcaagtgatcctcccacctcagcctccccagtagctgggacggcaggcacatgccaccacacccagctaattgtttaaatttttggtagagatggggtctcgccatgttgctcaggatggtctcgaactcctgggctcaaaggatcctcctgactcagcctcccaaagcaccaggtgtactttgggcctctcctgcctttttgattgaaagttccatgacgggcacacctggtgatgggtcctgagatggaacctgcttggcctccctcagcctggcctgagggacactcatagtccctcctctctccctaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 13917 - DNA, 1849 bp, Homo sapiens
aaacgctgcaagtcgcagcaggagctgccggaccggaagggcctgggttccggggacccctgtgttccccaactcccacccggcgcaggacccgcccccagtccaggccagagctgccgccccacccccactcaggggctccggtttcagaccctgtgaccaggacagcagctgcccaggacaggatagggggggcatcccccctttgaccacagaggccgctgggccagggcctcccctcccccacctgtcttccccctcctccaaactcctccttggtcccctgcagattcggggttgctgaatggcccaatggggaggttggggagccctggtctcccagtgtggattctgctctgccctcatggtgggcattgggattggctgtttgtctacatcttgtctttttaacttggctgggggctccctggggatttggactctggacttcaaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtggc

SEQ ID NO: 13918 - DNA, 982 bp, Homo sapiens
atgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccg

SEQ ID NO: 13919 - DNA, 1887 bp, Homo sapiens
ccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 13920 - DNA, 1388 bp, Homo sapiens
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 13921 - DNA, 2101 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 13922 - DNA, 2173 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 13923 - DNA, 2005 bp, Homo sapiens
ctccaggagactcagcactgccctgttccttcctagcctgagtcaggactgagcagagaatcctccaccacacacagcaggcactatctgccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccaagtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtgg

SEQ ID NO: 13924 - DNA, 5857 bp, Homo sapiens
gcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggagtgtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagttccagcaaattaaagcagaagttggaagctcatatggaaaaactcacagaggtccatgaagaattacagaagaaacaagaactcattgaagatcttcagccagatataaatcaaaatgtacaaaagatcaatgaacttgaagctgctcttcagaagaaagatgaagatatgaaagcaatggaggaaagatataaaatgtacttggagaaagccagaaatgtaataaaaactttggatcccaagttaaatccagcatcagctgaaataatgctactaagaaagcagttggcagagaaagagagaagaattgagattctggagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaaccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaaaacagtcttgaggcagggacatggagaactatgcaagggtgatttctttgacttaatatatacaaggctttacttctgtcccctaattcttccattgaatgtgtacctctaccttgtcatgtcatggaagatacaacatttggaagatctgacaattggaatgactttggaataataaaattgactaattggaaattttgcatattctgaaaatctaatctcatagttctaatttgtacctatggcaaataagggcttctggacatcatgtttaaaatgttaagcataagaaataaactgacatttgtaataggtgactttctgatggaaagcaagctatatatatatatatatatatatatatatatatatatatactttttgtgaaatgtctatatactttttaaggtaattaatgaagatttcagttattgcttttaagcataaagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaatataatagttgtgaaatgatttaagtaaataaactttatgcttctgtgtctgttga

SEQ ID NO: 13925 - DNA, 2216 bp, Homo sapiens
aaccagaatttattgacttccaatgttgagctaggcactggggaggactggagtggtagccagagctgtgtgtaattacagtggaagctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagttccagcaaattaaagcagaagttggaagctcatatggaaaaactcacagaggtccatgaagaattacagaagaaacaagaactcattgaagatcttcagccagatataaatcaaaatgtacaaaagatcaatgaacttgaagctgctcttcagaagaaagatgaagatatgaaagcaatggaggaaagatataaaatgtacttggagaaagccagaaatgtaataaaaactttggatcccaagttaaatccagcatcagctgaaataatgctactaagaaagcagttggcagagaaagagagaagaattgagattctggagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgc

SEQ ID NO: 13926 - DNA, 519 bp, Homo sapiens
aggtcactcagggcggcggggcgaggtcgtggacgccggctcctggaggagagccggtaggagggagtgtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacata

SEQ ID NO: 13927 - DNA, 2604 bp, Homo sapiens
gaggcggagcctgggcttgggggcggggcggggcctgcgcctaggggggcggggcggggcggcgctctaggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 13928 - DNA, 2610 bp, Homo sapiens
gaggcggagcctgggcttgggggcggggcggggcctgcgcctaggggggcggggcggggcggcgctctaggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagatgccatttccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 13929 - DNA, 3030 bp, Homo sapiens
cggtcccgagtgaaaggagaaggaggggcgctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttca

SEQ ID NO: 13930 - DNA, 1129 bp, Homo sapiens
gaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 13931 - DNA, 1601 bp, Homo sapiens
acagatgcaggggaaataaatgagaatcgtttttgagggagacctaaaactgtatcatcctagcccgaatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 13932 - DNA, 1164 bp, Homo sapiens
ctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 13933 - DNA, 1247 bp, Homo sapiens
acccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaga

SEQ ID NO: 13934 - DNA, 1542 bp, Homo sapiens
gcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactg

SEQ ID NO: 13935 - DNA, 1485 bp, Homo sapiens
aaagcgccaacccactgcggagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcaggcagggatacagttcctgcaaggggtcccggggggcgcgggaggcgcaggacgctaggctctgccgtcagcccgcaacagcgctcagtccagggagggaggcccgggtggggggcagccgtaagcccccgctcagcgtgcagccaccggggacttgcgcggccgtggcaccgctggagggggcggcctggggctggggctgcccggcggcgccgcgaccgccttccttcgctgcgtcccgcccgctccacgcctcgctcaccgccgccgcttctccctgccccgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 13936 - DNA, 1289 bp, Homo sapiens
acccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagaggtaatttccaaggttcttcccagctctgaagttgtgtgtcaaagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 13937 - DNA, 472 bp, Homo sapiens
ttccaaacccagggcttgcgcttgcctttgcctcttccacagtttctccaaaataaaaaaaaaaagaaaagaaaaacaaatgacaagtttgcaagactgataaaacagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaaca

SEQ ID NO: 13938 - DNA, 1090 bp, Homo sapiens
ctaccagactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaga

SEQ ID NO: 13939 - DNA, 635 bp, Homo sapiens
accagatctacgctttgaaatgaggcaacatctaactggaaactcgctcaaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggct

SEQ ID NO: 13940 - DNA, 496 bp, Homo sapiens
cggctagtcgcggactcgggcgaacccaccctcgcgatctgtcaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtgg

SEQ ID NO: 13941 - DNA, 1161 bp, Homo sapiens
acccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagaggtaatttccaaggttcttcccagctctgaagttgtgtgtcaaagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaga

SEQ ID NO: 13942 - DNA, 1672 bp, Homo sapiens
gcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactg

SEQ ID NO: 13943 - DNA, 980 bp, Homo sapiens
gagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcgcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaac

SEQ ID NO: 13944 - DNA, 1117 bp, Homo sapiens
acccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaga

SEQ ID NO: 13945 - DNA, 979 bp, Homo sapiens
gcggagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaac

SEQ ID NO: 13946 - DNA, 731 bp, Homo sapiens
gcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 13947 - DNA, 1771 bp, Homo sapiens
ggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaa

SEQ ID NO: 13948 - DNA, 1692 bp, Homo sapiens
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggc

SEQ ID NO: 13949 - DNA, 791 bp, Homo sapiens
ctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatga

SEQ ID NO: 13950 - DNA, 1815 bp, Homo sapiens
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatttaaagataatggaattaacagtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcag

SEQ ID NO: 13951 - DNA, 1879 bp, Homo sapiens
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatttaaagataatggaattaacagtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcag

SEQ ID NO: 13952 - DNA, 1794 bp, Homo sapiens
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgttctagctacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgta

SEQ ID NO: 13953 - DNA, 740 bp, Homo sapiens
cgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcac

SEQ ID NO: 13954 - DNA, 1788 bp, Homo sapiens
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctgcgatattttctatttaagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcag

SEQ ID NO: 13955 - DNA, 8869 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccac

SEQ ID NO: 13956 - DNA, 8213 bp, Homo sapiens
aagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttg

SEQ ID NO: 13957 - DNA, 8375 bp, Homo sapiens
aggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatggcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaat

SEQ ID NO: 13958 - DNA, 4071 bp, Homo sapiens
cacgtgaccccagcacagctggaggcgggtccccgccctccccagggagcagccggttgaggcgggagcggtgcattgtgggcagaggggcgggggttgggaagatggcggctcccagcctcctcaactggaggcgagtttcttccttcacggggccggtcccccgcgcccggcacggacaccgagcggtggccatccgggagctgatgatcatctttggagggggaaatgagggcatcgcggatgagctgcacgtctacaacacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaaggagtcaggatggaccctcacagacaaggcagtaataacatcgttcctaacagtatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacaggtaacttgttttaaaccttttaggaatttcatggttccactgcctatttaaatctggaattaatatacagagcaataattgcagaaaagatatttcaaactaagagcttcaataactgcaggggcacaggtctatctttttttataccacataaccttatgccagtttaggttgactgagtagctatgtcctcaaatttcatgtatgataccccccagcaaagatggatttaattgtgcagaattgatatatatgtgtgttccagttactaatttaaagtgtatagaatattttaatatataatttttgtaaagaactgggatttttatactacagtatttgtaattaatgtgtctcactaattaagtttctcttgaagaaaatatgcaaattgttagacacataatgagtggtttccaaactctaaagataaaataaatgcactactatggtgttgttagaata

SEQ ID NO: 13959 - DNA, 1066 bp, Homo sapiens
cgggcgggcgggcgggcgaagctgggctcggggccaagcgaggtctagccggagcgactgtgccccgcctcctgggcggagcgggcggctccccatggtcagagcctcgtgccggctcggcagcgcccggacgccgagcccagcgcgtcggccccccggcgtgcgggcgtctcagagccgcggaggggccgccgggaccgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatctta

SEQ ID NO: 13960 - DNA, 742 bp, Homo sapiens
agctaatttaaggctggacacagagtcagcaacacacaagacatcatcttgaaggaaggatggctttggccagaccaagaccgagacttggagacctgattgagatttctcgctttggctatgcacactgggccatctacgtgggagatggctatgtggtccatctggctccggcaagtgaaattgctggagctggtgcggccagtgtcctgtctgccctgaccaacaaagccatagtgaagaaggaactgctgtctgtggtggctgggggagacaactacagggtcaataacaagcacgatgacagatacacaccactgccttccaacaaaatcgtcaagcgggcagaggagttggtggggcaggagttgccttattcgctgaccagtgacaactgcgagcacttcgtgaaccatctgcgctatggcgtctcccgcagtgaccaggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcacaggaaaatgtatttggaaatgcagcttagtatgaattctattaaagacacaattgggctctgc

SEQ ID NO: 13961 - DNA, 1114 bp, Homo sapiens
gtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaa

SEQ ID NO: 13962 - DNA, 1798 bp, Homo sapiens
gcaaaagtatcgggggcgggactcgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatcatct

SEQ ID NO: 13963 - DNA, 1197 bp, Homo sapiens
aagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacgggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttc

SEQ ID NO: 13964 - DNA, 1907 bp, Homo sapiens
gcaaaagtatcgggggcgggactcgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatcatct

SEQ ID NO: 13965 - DNA, 2120 bp, Homo sapiens
caatgggctgggccgcgcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgc

SEQ ID NO: 13966 - DNA, 1214 bp, Homo sapiens
ggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 13967 - DNA, 1892 bp, Homo sapiens
atgggctgggccgcgcggccgcgcgcactcgcacccgctgcccccgaggccctcctgcactctccccggcgccgctctccggccctcgccctgtccgccgccaccgccgccgccgccagaggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 13968 - DNA, 2367 bp, Homo sapiens
tctggcagcgcgcagctgaccaggaagacgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgc

SEQ ID NO: 13969 - DNA, 1450 bp, Homo sapiens
cagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggca

SEQ ID NO: 13970 - DNA, 2541 bp, Homo sapiens
gggagctggtccctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcctggggagtttgtggtggccatcggcagtcccttcgccctacagaacacagtgacaacgggcatcgtcagcactgcccagcgggagggcagggagctgggcctccgggactccgacatggactacatccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgcccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaggcaggcaggaggccgcggggagcacgtggaaagttggctgctgcctggggaagcttctcctccccaaggcggccatggggcagcctgcagaggacagtggacgtggagctgcggggtgtgaggactgagccggcttccccttcccacgcagctctgggatgcagcagccgctcgcatggaagtgccgcccagaggcatgcaggctgctgggcaccaccccctcatccagggaacgagtgtgtctcaaggggcatttgtgagctttgctgtaaatggattcccagtgttgcttgtactgtatgtttctctactgtatggaaaataaagtttacaagcacacggttctcagcca

SEQ ID NO: 13971 - DNA, 2095 bp, Homo sapiens
gcggaggcggcgccgtggccgggagaaagtgtctctcatttaggagggtttgcaggtccagagtaaagtcactgaagagtggaagcgaggaaggaacaggatgattagacctcagctgcggaccgcggggctgggacgatgcctcctgccggggctgctgctgctcctggtgcccgtcctctgggccggggctgaaaagctacatacccagccctcctgccccgcggtctgccagcccacgcgctgccccgcgctgcccacctgcgcgctggggaccacgccggtgttcgacctgtgccgctgttgccgcgtctgccccgcggccgagcgtgaagtctgcggcggggcgcagggccaaccgtgcgccccggggctgcagtgcctccagccgctgcgccccgggttccccagcacctgcggttgcccgacgctgggaggggccgtgtgcggcagcgacaggcgcacctaccccagcatgtgcgcgctccgggccgaaaaccgcgccgcgcgccgcctgggcaaggtcccggccgtgcctgtgcagtgggggaactgcggggatacagggaccagaagcgcaggcccgctcaggaggaattacaacttcatcgccgcggtggtggagaaggtggcgccatcggtggttcacgtgcagctgtggggcaggttacttcacggcagcaggcttgttcctgtgtacagtggctctgggttcatagtgtctgaggacgggctcattattaccaatgcccatgttgtcaggaaccagcagtggattgaggtggtgctccagaatggggcccgttatgaagctgttgtcaaggatattgaccttaaattggatcttgcggtgattaagattgaatcaaatgctgaacttcctgtactgatgctgggaagatcatctgaccttcgggctggagagtttgtggtggctttgggcagcccattttctctgcagaacacagctactgcaggaattgtcagcaccaaacagcgagggggcaaagaactggggatgaaggattcagatatggactacgtccagattgatgccacaattaattatgggaattctggtggtcctctggtgaacttggatggtgatgtgattggcgtcaattcattgagggtgactgatggaatctcctttgcaattccttcagatcgagttaggcagttcttggcagaataccatgagcaccagatgaaaggaaaggcgttttcaaataagaaatatctgggtctgcaaatgctgtccctcactgtgccccttagtgaagaattgaaaatgcattatccagatttccctgatgtgagttctggggtttatgtatgtaaagtggttgaaggaacagctgctcaaagctctggattgagagatcacgatgtaattgtcaacataaatgggaaacctattactactacaactgatgttgttaaagctcttgacagtgattccctttccatggctgttcttcggggaaaagataatttgctcctgacagtcatacctgaaacaatcaattaaatatcttgttttaaagtgggattatctaaaaaaaaaaaaaccagttatatcacgtggtttgtattggagatgtgccaaacatggcaagaagtttttggatctttttcttacaaagaaaaatggatggttatcaacccaaatgcccatcaatgacagactggataaagcaaatgtggtacatatacaccatggaatactatgcagccataaaaagcaacagtcctctgcagggacatggatggagctggaaaccattatcctcagcaaactaacgcaggaacagaaaaccaaatactgcatgttctcacttataagtgggagctgaacaatgagaacacatgaacatagggaggggaacaacacacactggggcctggcagtgggtagggtagagggagggagagcattagcaaaaatagctaatgcatgctgggcttaacacccaggtgatgggttgattgataggtgcagcaaaccatcatggcacacatttacctatgaaacaaacctgcacatcctgcatatgtacctcagaacttaaaaataaaaataaaaagaaaaatg

SEQ ID NO: 13972 - DNA, 9027 bp, Homo sapiens
gctgctgggcggcggcagggtggcggacggagcgggggaccggggagcggcggccgccggaggaggttatgtttgtgtttggggttgtcaagtgaaggagggatcccaggcgccgccgccgccgccgcgcgggggtcgcggagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcactttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttta

SEQ ID NO: 13973 - DNA, 576 bp, Homo sapiens
gtgcaaccgccgaccttgcagaggggatggctgcgtgcgggagacccttggcacttctgggcgccctcgccgcgcgcgagccgagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctg

SEQ ID NO: 13974 - DNA, 585 bp, Homo sapiens
tcctcccgccggccccaaagacgctaaacgtgccctactctgccccgggggagagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaac

SEQ ID NO: 13975 - DNA, 579 bp, Homo sapiens
tttcctctcacgcccacttccaacctaggaggcttttggtttctgcttttttgtttttaaaattaaaagttaaacccaggaagctttggatcagacttttgtgttgcagttcggcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctga

SEQ ID NO: 13976 - DNA, 2085 bp, Homo sapiens
ttgcacttgctctccttaattcaaaacagaacactggaaaatcactatactgtcaagcaataactacccattccaagtcagacttattggtctattcaagcaagtggaaaagcagcttaagcaagatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgc

SEQ ID NO: 13977 - DNA, 2640 bp, Homo sapiens
ggagataaattttcctttcagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttt

SEQ ID NO: 13978 - DNA, 9524 bp, Homo sapiens
gtggagcctttgaattttttaaaagaccatagtaatcagatctacttgaaaaattaagtgaattgatttggttggaatgctcttttaccgatgctttaacatacagccactaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgctt

SEQ ID NO: 13979 - DNA, 9723 bp, Homo sapiens
gctggaggcaggaatgtgcctgcttactaatgagcgacgtgcaccggcgcgcacggcccggccaccgctgcggctgcggcggccggcggcggcccgttgtcaggtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttg

SEQ ID NO: 13980 - DNA, 9621 bp, Homo sapiens
gtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttga

SEQ ID NO: 13981 - DNA, 8465 bp, Homo sapiens
ccacaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacaga

SEQ ID NO: 13982 - DNA, 12193 bp, Homo sapiens
cctgcctggccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacagatgcgatcaaggttcctgtttattgccacttcacccccctgcccagctcgtagccacccctctctgccagcagaaaggccagtgtccccaggcagaggggcacaaacacaggcaggtgacccccacccaggccccagcaggcaggcccagaaaaactaatcttttccttttttttttttttttttttttttgcaagaaaataaaatgatacttttcctaggatttcaacacaaaataataggtgcaggtagaaggaggagggctggctccccaagggctcctggatactctggtagtctgagtcatgggcccatcctggcactccacaggtgggcaggccaccccacccacgcacccccactccagacacctcccttctgcaccccaccctggccccctgggctggggaaggagccctgactgtccgtccctggctcccaagcccctgaccgaggcctcactctcctgttgcctcctctgttctaaaaccaccaaaccacccacaaaggcagaagtggcagggcccgagccctagcggccgttcctgagactgggttttgggttttgtttcatcttggtccctggggtacaagggagcctgttcccctcatggctgggtttttccagttctccacagcagaggtttgcggggaactgtttcaggaccactttgccacaggaccgtttccccccgtccctgcccctgtctccactaccccaaggaaatacccacaactgtggctggtggatacggcctggacctgtttgctgtcttacacctcttttttaaaaagagagaggatggtgtttgatacttcacccagccaccacagattcttttgacctagaggatttttgaattgtcctaactcgttggaattctccaaagcaatcagtgtgagccagtgcctcttccttacccacatctctactttcaagaagctgccctgcatttcctggggcaaaactctactttgtaagaaaaataataggaccagaaatttaaatcccaaattgaactatggaacttgaactctagcgtgttcgccccaactgggagaggtgagctttttcccagtgtttcagaactgattttctttactttctacaagggagggcagcacagggactacggttgaggcccgtgaaggctgggtttgatgccaccctatacagagcagggacctctctggctaatccccagtcctcagccaggctgtgtgaatcaagtgcctgccccagggctcttgagctattgaagctgcttgggtacaggacacagtaggtggggagggttaagacccttctgtgagttccctgtgcggggctgtacttgcctcttccaattcgtggcctttccctgcttggtccctactagacagacaaaccagccacagtccagcctgcagccagaccaccttgttcactcattctcctttgcctcagagctaagacaaaaatgagacagaaggcagggctccctgggagtccactgtgctccagggttctggggaatcagggttagccagcagctcctggctgcttccctcagagactagggctctcatcctccccaagagaagcagcaagcccagcctggaccacactgtccatattgctggacagtggcctgacagaaagtgactcctccaagtcccaggaggccagggcttttctcatccttgcctttcagccctaacccatgggactgcccacggattggagacttcaagggctgaggtctgggagctgcataaagggcattgcttcagcccaggttagaaatctgcctgggcaagctcttcctgccccagacctacaaagcagcagaccgggggctctggtggactagcccctgacattggtggggggccccacaccactccaccccaccctgccttccagctctcctgggcatttttctccctgtactcaaacagcctacccacccaaggtttcctccctgggcagcctagcaatgaacagtgcagccggcagggcagaggcccggcagtcaccgggcccgtcaggctcaggcagagaagccacaggggccaggagtcactggagactatttctaaatgatgggggtaaatgcacaaatagaatctcaccaaagggctgcctccacattgatgccgtgcccagagggacagaaccaatgccaccagcctgggtatatgtcactgggcacagctctaaccccctcctccggactctagtcccgctcctctgcgcacagagcccccagcccacaggtacaccttcatgatttggagaaagacgctcgccccatgcacgccctcctctgggccttctgccctgctcccagtcacttccaagcttcctgtttgcctgtgatgttattgtgcctgttgagggaagcagcagaggaggcagtggctgacttggcacagatgcctgctacgtgctctgttgaaatgcgcggggtggccattcctcggtacagactagtcctggtccttgggtgtgggcagtgggggaggaaccaactggtcgaggtttcagagccaaaccttgcctttggttggtgagtccttgccccccaggcctgcgctccacgatgcctttcacccttggcaatctcagggccatcctgggtagtaaccccactcctctctgctcccgcccgcacctgtggctctcactctgggctcaacccctgcaaccctccaggagcccgacagcagccagctgcctgcactgtcgcctccgtaagctccaacttccagacccagaagtccctctgcttccctctgttggaaaaagcctaaaagaattagcttccagattcctctagcccctgctccattcccacccagtccttctgaagaggaatgagcaatacatctgagctggatttctctctagtcctttctccagacaaatccttcttaaagcaaaagtcctggctgagcacctgtccttggggaccgatctgccgtgtgaccaggggaagaaagttcccgaaagcctgttccaccaattctgcttctgtgttgtgaatccagtctgctttccattagaaaaccgcttcggcacttatggtcactttaataaatctagtatgtaaaaaaagaaagaaagaaaagaaacagaaaaaagaaacgtgcaggcaaatgtaaaatacaatgctctctgtaagataaatatttgcctttttttctaaaaggtgtacgtattctgtatgtgaaattgtctgtagaaagtttctatgttcttaaatggcaatacattccaaaaattgtactgtagatatgtacagcaaccgcactgggatggggtagttttgcctgtaattttatttaaactccagtttccacacttgcatcttgcaatgttggtatggtatatatcagtgcaaaagaaaaaacaaaacagaaacaaacaaaaaaaaaaaacaaaaatccacgcaggtctaaagcacagagtctgacgtacaaaaggaaaaatgctcagtattgatgtgtgtgacctttgttgtaaattacatctgtactgtgaatgagaagtttttacaagtataataattgcctttattacagctctggctgagtgttcagcctgaggatattttttaaaaaaaaaagaattagcatgttggaataaatttgaaaatcccaacata

SEQ ID NO: 13983 - DNA, 12319 bp, Homo sapiens
ctcacaaccagccgactctcccattatccagctgcctagtttggtgcttcaatgtacatggctattccgtgtgcatatgtgtgtatacaaacacgcatgcatgcctggatggacatacgtatgcacaggttattttttaaggacaattctttcaataaggtctttaccccttacttgaaacaggtgttcatgaaaaaaatgcacaaaatcctgcctggccggaataattcatgaagaaggggctggatccgtgggtcagagaacacaggaccagtttgccatcccaaggccgaaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacagatgcgatcaaggttcctgtttattgccacttcacccccctgcccagctcgtagccacccctctctgccagcagaaaggccagtgtccccaggcagaggggcacaaacacaggcaggtgacccccacccaggccccagcaggcaggcccagaaaaactaatcttttccttttttttttttttttttttttttgcaagaaaataaaatgatacttttcctaggatttcaacacaaaataataggtgcaggtagaaggaggagggctggctccccaagggctcctggatactctggtagtctgagtcatgggcccatcctggcactccacaggtgggcaggccaccccacccacgcacccccactccagacacctcccttctgcaccccaccctggccccctgggctggggaaggagccctgactgtccgtccctggctcccaagcccctgaccgaggcctcactctcctgttgcctcctctgttctaaaaccaccaaaccacccacaaaggcagaagtggcagggcccgagccctagcggccgttcctgagactgggttttgggttttgtttcatcttggtccctggggtacaagggagcctgttcccctcatggctgggtttttccagttctccacagcagaggtttgcggggaactgtttcaggaccactttgccacaggaccgtttccccccgtccctgcccctgtctccactaccccaaggaaatacccacaactgtggctggtggatacggcctggacctgtttgctgtcttacacctcttttttaaaaagagagaggatggtgtttgatacttcacccagccaccacagattcttttgacctagaggatttttgaattgtcctaactcgttggaattctccaaagcaatcagtgtgagccagtgcctcttccttacccacatctctactttcaagaagctgccctgcatttcctggggcaaaactctactttgtaagaaaaataataggaccagaaatttaaatcccaaattgaactatggaacttgaactctagcgtgttcgccccaactgggagaggtgagctttttcccagtgtttcagaactgattttctttactttctacaagggagggcagcacagggactacggttgaggcccgtgaaggctgggtttgatgccaccctatacagagcagggacctctctggctaatccccagtcctcagccaggctgtgtgaatcaagtgcctgccccagggctcttgagctattgaagctgcttgggtacaggacacagtaggtggggagggttaagacccttctgtgagttccctgtgcggggctgtacttgcctcttccaattcgtggcctttccctgcttggtccctactagacagacaaaccagccacagtccagcctgcagccagaccaccttgttcactcattctcctttgcctcagagctaagacaaaaatgagacagaaggcagggctccctgggagtccactgtgctccagggttctggggaatcagggttagccagcagctcctggctgcttccctcagagactagggctctcatcctccccaagagaagcagcaagcccagcctggaccacactgtccatattgctggacagtggcctgacagaaagtgactcctccaagtcccaggaggccagggcttttctcatccttgcctttcagccctaacccatgggactgcccacggattggagacttcaagggctgaggtctgggagctgcataaagggcattgcttcagcccaggttagaaatctgcctgggcaagctcttcctgccccagacctacaaagcagcagaccgggggctctggtggactagcccctgacattggtggggggccccacaccactccaccccaccctgccttccagctctcctgggcatttttctccctgtactcaaacagcctacccacccaaggtttcctccctgggcagcctagcaatgaacagtgcagccggcagggcagaggcccggcagtcaccgggcccgtcaggctcaggcagagaagccacaggggccaggagtcactggagactatttctaaatgatgggggtaaatgcacaaatagaatctcaccaaagggctgcctccacattgatgccgtgcccagagggacagaaccaatgccaccagcctgggtatatgtcactgggcacagctctaaccccctcctccggactctagtcccgctcctctgcgcacagagcccccagcccacaggtacaccttcatgatttggagaaagacgctcgccccatgcacgccctcctctgggccttctgccctgctcccagtcacttccaagcttcctgtttgcctgtgatgttattgtgcctgttgagggaagcagcagaggaggcagtggctgacttggcacagatgcctgctacgtgctctgttgaaatgcgcggggtggccattcctcggtacagactagtcctggtccttgggtgtgggcagtgggggaggaaccaactggtcgaggtttcagagccaaaccttgcctttggttggtgagtccttgccccccaggcctgcgctccacgatgcctttcacccttggcaatctcagggccatcctgggtagtaaccccactcctctctgctcccgcccgcacctgtggctctcactctgggctcaacccctgcaaccctccaggagcccgacagcagccagctgcctgcactgtcgcctccgtaagctccaacttccagacccagaagtccctctgcttccctctgttggaaaaagcctaaaagaattagcttccagattcctctagcccctgctccattcccacccagtccttctgaagaggaatgagcaatacatctgagctggatttctctctagtcctttctccagacaaatccttcttaaagcaaaagtcctggctgagcacctgtccttggggaccgatctgccgtgtgaccaggggaagaaagttcccgaaagcctgttccaccaattctgcttctgtgttgtgaatccagtctgctttccattagaaaaccgcttcggcacttatggtcactttaataaatctagtatgtaaaaaaagaaagaaagaaaagaaacagaaaaaagaaacgtgcaggcaaatgtaaaatacaatgctctctgtaagataaatatttgcctttttttctaaaaggtgtacgtattctgtatgtgaaattgtctgtagaaagtttctatgttcttaaatggcaatacattccaaaaattgtactgtagatatgtacagcaaccgcactgggatggggtagttttgcctgtaattttatttaaactccagtttccacacttgcatcttgcaatgttggtatggtatatatcagtgcaaaagaaaaaacaaaacagaaacaaacaaaaaaaaaaaacaaaaatccacgcaggtctaaagcacagagtctgacgtacaaaaggaaaaatgctcagtattgatgtgtgtgacctttgttgtaaattacatctgtactgtgaatgagaagtttttacaagtataataattgcctttattacagctctggctgagtgttcagcctgaggatattttttaaaaaaaaaagaattagcatgttggaataaatttgaaaatcccaacata

SEQ ID NO: 13984 - DNA, 8024 bp, Homo sapiens
ccacaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttag

SEQ ID NO: 13985 - DNA, 13464 bp, Homo sapiens
gctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaat

SEQ ID NO: 13986 - DNA, 8013 bp, Homo sapiens
gcccctgactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccattggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggc

SEQ ID NO: 13987 - DNA, 7066 bp, Homo sapiens
gactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagagggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctct

SEQ ID NO: 13988 - DNA, 4539 bp, Homo sapiens
ctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctacgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgtttgttgtc

SEQ ID NO: 13989 - DNA, 753 bp, Homo sapiens
atggcacatgttgggacatcgagggtgggatctgtcctctccatgagtctttccattcaccttcttgtcccaactatgactaaaggggagacggggaagccagggcatcacgaagctcctagaacacttcaggcatttccgtggacgtgggcacgggcttccccaggcgtttctgtggacatgagcgctgggcttcctcagtctctgctgtgctggccgggtgctcccctcctcccaacccctccactgccctctgccacctatgtgggccacagcctgggtctgccaagagcagggtccagcgtggggccctggttcagtggccgctgggttgggggggccctggttcagtggccgctgggtggggggggccctggttcggtggccgctgggttggggggccccctggttcggtggctgctgggtgggggggccctggttcggtggccgctgggtggggggggccctggttcggtggccgctgggtggggggggccctggttcggtggccgctgggtgggggggccccctggttcggtggctgctgggtgggggggccctgttcggtggccgctgggtggggggggccctggttcggtggccactgggtggggggggccctggttcggtggccgctgggtgggggggccccctggttcggtggccgctgggtgtgggggggccctggttcagtggccgctgggtgggggttctctccacagcatccccagtttcccgcgggcctggaggtga

SEQ ID NO: 13990 - DNA, 4087 bp, Homo sapiens
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagagagcgtgtgggtgggttcccagctgcaggacctgcgggagaagtacatggattgtgggggcatgctgattgagatgcaggaggaggtgaagaccctccgccagcaacccccagtgtccactgggtctgccacccattacccatacagcgtgcctctggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 13991 - DNA, 3880 bp, Homo sapiens
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 13992 - DNA, 3931 bp, Homo sapiens
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagaggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 13993 - DNA, 5683 bp, Homo sapiens
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggcccagcctccagctgtctctctagggagtgtgtgtgtgcacttggcagggcgaagttgtagagaaagggtggatgctaatattgaagtatgtgccgaggactcctattaaatacgccgtttaatcatagcagcagctcctagagggcggtgggtgatgtcataagtgtctgttggatggagaaactcaggccagagtaggttaagtgatgccctcaccagcagatcatggctagtgtggagctgggatttgagctcatgcttccctgatcctttcaccccagagactgactcagtggcctggctgtgaaagataggatgggagagagtcacccactgtcttagggtgaagtccccagagcagacctggaacagggtttaggaacaagtatagtcgccctccgtatcctcaggctctgcatccgtggagtcaactaaccacagatagaaaatatttgggggaggctgggtgcagtggctcatgcctgtaatcctagcactttgggaggccgaggtgggtggatcatttgaggtcaggagttcgagaccagcctggccaacatggtgaaaccccgtctccactaaaaatacaaaaattagctgggcgtggtggtgggtgcctgtaatcccagctacttgggaggctgaggcaggaggatcacttgaacccaggaggcagaggttgcagtgagcggagatcatgccactgcactccagtctgggcaacaacagcgagactccatttgaaaacacaagaaaatatctgggggaggccaggcgcggtggctcatgcctgtaatcccagcactttgggaggctgaggtgggtggatcacttgaggtcaggagttcgagaccagcctggtcaacatggtgaaaccccgtctctactaaaaatacaaaaaaaattagctgggcatggtggcagcccctgtaatcccagctacttgggaggctgaggtgagaggatcacttgagcttggaaggttgaggttgcagtgagctgaggttgcaccactgtactccaacctgggtgacagagtaagaccctgtctcaaaaaaagagaaaagaaaatgacagacaaaccagacatgggggaaattgccagctttgataaagctttgaaggaaacggagatgcaggagaacaccttgtggaccagagaccactgagcaggagaagcagtgaaatttcctaaaatctggaggattccctgcccctgttatcttcaagtccccagtggtgatgtggaagaaaagcaacctgcaaggtggatgcaagccacaagctgctctgtgaacctgggcacctcacacagatgccactggcctgtgggtctctgaggggacccgcaaatgggactgccaaattctctggtttgctccaggatattatagaaaattatttatatgaatagtaaaaataaaacacactttgtggcccccctgccaaaagaatatcattgagaagattattgctgtggctaaccgggtctcagtcctgctgggaactctgggggacagtagaatatatctcagagtagcctgggtgaggtggctcacacctgtaatcccagcacattgggagggcgaggcaggtggatcacctgaggtcaggagttcgagaccagcctgaccaatggagaaaccccgtctccactaaagatacaaaattaactgggcatggtggcacacatgcctgtaatcccagctactcgggaggctgagacaggagaatcgcttgaatccaggaggtggaggttgcggtgagctgagattgcaccattacaccccagcctgggcaataagagtgaaactccgtctcaagg

SEQ ID NO: 13994 - DNA, 1025 bp, Homo sapiens
ctgccttccctgtggcatcatgaagtttcgcgccaagatcaccggcaaaggctgtctagagctgttcattcacgtcagcggcaccgtcgcgaggctagcgaaggtctgcgtgctccgcgtgcgccctgacagcctgtgcttcggccccgcgggttccggcggcctccacgaggccaggctgtggtgcgaggtgcggcagggggccttccagcagtttcgcatggaaggtgtctcggaagatctcgatgagatccacctggagctgacggcggagcacctgtcccgggcggcgagaagcgcagcgggcgcgtcctccctgaagctgcagctgacccacaagcgccgcccctccctcacggtggcggtggagctggtctcgtccctgggccgcgctcgcagcgtggtgcacgatctgcccgtgcgggtgcttcccaggagagtgtggcgggactgcctgccgcccagcctgcgcgcctccgacgcgagcatccgcctgccgcgctggaggacgctgaggagcatcgtggagaggatggcgaacgtgggcagtcacgtgctggtggaagcaaacctcagtggcaggatgaccctgagtatagagacggaggtggtgtccattcaaagttattttaaaaatcttggaaaccctccccagtcggctgtgggtgtgcctgaaaacagagacctggagagcatggtgcaagtgcgggtggacaatcggaagcttctgcagtttttggagggacagcaaatacatcctacgacggccctgtgcaatatttgggacaatactcttcttcagcttgttttggttcaagaagatgtctctcttcagtatttcattcctgccttgtaaaaattcagccagcttagattttttttttaaggttttgatcttttcaaaactaaaacagaccctgagttaattgggttgaaaatttggaccttcactgacttatgcagggcgtatattttgttgagcccttcctcctttgcaaaatttatattaaagcattggtaaaaca

SEQ ID NO: 13995 - DNA, 5607 bp, Homo sapiens
atccaaggatacaatagcagttgtttgttaagagaaatttaaactcaacaccaatactgagtccagtaaaccagaaaatatgcttctggtgatttgggtggaaggccatctccagtttaagaagctttatgtgccactatcatcattgtctgttatccttgatctcctttggtgaggggaaggcgggaaagagaggacctctccgacccttggatttttcttttaagcagaggctaataaaacaaagcgcaaactgactgtcctgaggagtctgctcacaccgctgccccgcagatcattccacagaccccttgtcccatcccttctggacagacccaggactgatgagggttcgggttcgggaggtgtggtgtggtgggggcttgtgtggctgtagcggccggctttcctaaaccccagagcgggatactcgggatctgagcagaggggaaagtcatctaagaggctgctgctttacaaggtctgggcacagagctgcccctcccttcctccctgaagtttgcatgaagtgcacattaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacgcacacacacacacactctcacactcgcccagagacaaacttaaggtgaggagaaagagcgctagcttcacttgatctccagcttccaacttaagcagaacttgagagcatccgaactcctggatttcaggacaagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtggggggcagaacacagtgcccggagtcaggaactacggattttgggataaagataaaagcagatatgatgttttctgttttacatccaatttcaatggccgtttttactatctgatccaccccaccaaactgacctatgatgaagcggtgcaagcttgtctcaatgatggtgctcagattgcaaaagtgggccagatatttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagttaccaaaactgtgataacccttttttacttactgtaaagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgaccaaaaaaaaaaaaaaaaattcatatggattccaatccatagtaacaagcacagttaaaactcctcaataatcccatttatatgaagcatgacacataaataagcagataatatttaaccaatgaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatgtagattttcctcccatgaacatgagtaaataaatctgtttcctgaatggattgtggttgcatttaaagctctgtaataattctaataaatttactctatagagttctgtgtgtggaaggtatagaacaattggaagtccatgaaaccataactataatcatatattattcagacaaaatattgtaataaaagtaggtcctttctttcatcaaaaacatatctgaaaattttcagatgctttaatattaaaagatgacaatgttatgtatgcacatttttaagttaggttggatatgcaaactgtacaaaactataaatccaaagagtttgtaaagtttaaactcaaacactggtggtataaatagaacttgcacttctaaattaaggaagatacctaaatggtctaggatgagatgatatattatttaaagaggggactatctcccaaataacaactttaacacctcaaatatgggggctagctcattgaaagaagtccatacttgaactattattatgtatgttccgataattttgttgaaaatacaagtgggaacaaatttctattgaagcaaacatctaattttcagttatgtccagaactctactttataatgttaaatgtagtagtatttcttaacttttaaatacttactactataggaattggtgctgatcaaaatctctggagtgactgttagctgattaaaatctataccacttacacatcatttttccattcgtgtaaaaaacaaaaaatcttaacacagtgaatactgctgagcagaattttttcttctcattttgctcaaaggaccagaatttccatgccctttatactcatacttgaatgagtctttttaatgttctcattttgctgtttttccaccaaatgtctattttcctacttcattccccaagatgtctcactgagcaggtctgaaaaagaaaggttattctaatacaattcctaacagaaagttggtacaacactggctaattcagaaatcgctcctcagacttagattccaagagtatcaaagagattagatgggaggctgggccaggaacccttgttttaatgtatttgtccataattaacactggtgaccatataaggaacaaagtatatctgcacatttcactgagacatctacattggaaaacccaaacaaaaagaagcaattcaaataaaaagacaacataagaacgaaaataagttggtcacattaacactggaagccatctttaagtgagtgctgtcatattgtgtcacagtaatttttagccaaatatggcgtttgtaaatttaaactttctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaagaaatatcaacggataactgacatcgttttgttaagaagttaactgtatcgtagctcactactgccagagcggcaatggatgtacaacgaaagagatgaaaaatacaaaagttattaagccacctgattaaaagaaaaccaatatttaaaggcatttaatagatatcaagtataactttgaggagaagaatcaatctgtattaccaaaaaaaaaatgttttgattttctgtaagatacaatgaactggtacattaaaagtcaattttgtgttactgcagtatcttttaattcttctgagttgtagaatcttagctatttttctttgtgtcaaactctgtcaatacattatttccaagaaaggcatttaattcattcttgttctgatacatttgacttcaaattgtaaatacgtacaattttcatttcctagtactcttgcaaagtcaaaaaaaaaaaaagagcatttatatggtgtcgctaaatcaactatagtattatcccaaaatatattgacttttttctctttgtatatgactcaaagcataattaattttgcccaccagttcagcaatcccagaaatctattgtgttgttgattagattaacacattttaaatgctttataacttaatcatgagtgctgaattaaaaaaaggtttttcttttcata

SEQ ID NO: 13996 - DNA, 568 bp, Homo sapiens
aagattctttgggctataaagatgaagagtctacttcttctggtgctgatttcaatctgctgggctgatcatctttcagacaactatactctggatcatgacagagctattcacatccaagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggacc

SEQ ID NO: 13997 - DNA, 788 bp, Homo sapiens
aataagtgaattaggttctggagtagaggctctcctacaaggacctccaggaacagactcagagctctttaataagtatcccagggagtcaggctttcttggaaaaaacaaattagtgtgagaagccagtactgtgcaatttcagttttaaaaatagccggtattgtcaaggctgctgtgtgcatgagagaaatagaaggtccttgttaattttcgtgtcagcttccacattaaaaccaagaagctccactgaaatccttgcctggcaaatactgcaaaggttataagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggt

SEQ ID NO: 13998 - DNA, 799 bp, Homo sapiens
gtggatccgctgactgcagagaccctacctggcactctaagttggtgcgtcagcattttaggttgaaatgaatgaaaaatcaatcaggatgactgcagtggtagcgtgcacaactctaacctagtttgttcataattttcaactattcaccgtagacccaagcagtatgtaagatgtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcgg

SEQ ID NO: 13999 - DNA, 989 bp, Homo sapiens
ggtagcaggaattgttcaaagctgccgtcttcggctcttaaaggcagctacagtaactttctgaacagattgggttaaatatttttacagacccattctatgatgataaggcggtaataagttgtgcagtgcaacactccaaagggttccaaatctcacaagcctctttgtatgtgatgctctcgcagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtggggggcagaacacagtgcccggagtcaggaactacggattttgggataaagataaaagcagatatgatgttttctgttttacatccaatttcaatg

SEQ ID NO: 14000 - DNA, 560 bp, Homo sapiens
ccgaactcctggatttcaggacaagcgccccttctctgattcctgtaaacaagcagagagcacatcacaactctgtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagca

SEQ ID NO: 14001 - DNA, 3009 bp, Homo sapiens
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggacatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaag

SEQ ID NO: 14002 - DNA, 868 bp, Homo sapiens
atagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagatggaggaaaactttatttgctccaggaagacaatggccttatcttcaacctggatcctcagccctaaaaagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcag

SEQ ID NO: 14003 - DNA, 1042 bp, Homo sapiens
aacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggcataaaaaccagacatctaaaggtggtgctaggggaccaggacctgaagaaagaagaatttcatgagcagagctttagggtggagaagatattcaagtacagccactacaatgaaagagatgagattccccacaatgatattggcaagttcctc

SEQ ID NO: 14004 - DNA, 2972 bp, Homo sapiens
catagaaaccactaacgaaaattaactgtttactttttcactgtctgcccatctcctcctcaaccagttcacatctgcctccttcatccccacatcaccaatgcctggctcacagcagagcttctttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggacatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaa

SEQ ID NO: 14005 - DNA, 2087 bp, Homo sapiens
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttc

SEQ ID NO: 14006 - DNA, 1948 bp, Homo sapiens
ggctgggagagcaagccggagagaagagagagcccggccagacccactgcgatgagacaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcagttttgcagggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcag

SEQ ID NO: 14007 - DNA, 1131 bp, Homo sapiens
ggctgggagagcaagccggagagaagagagagcccggccagacccactgcgatgagacaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctagaatcctgcccaggccccagggagcacgcgatgatgccctcattcctcgcccccgtgcaggtacacctccaggtcccgctgctactcagagacgccctcgtccttcctgcggtggctgagccagcagacacgctggtccaagtcgtacttccgtga

SEQ ID NO: 14008 - DNA, 2090 bp, Homo sapiens
gcaagccggagagaagagagagcccggccagacccactgcgatgagacaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttc

SEQ ID NO: 14009 - DNA, 4190 bp, Homo sapiens
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtttatcaaaggttttgttctgtggcctgaatttactgggtcctacctacacattgaacatgttttgcctgtcttttttttttttttcaacttgccagttcactttacatgttagtataatgtttacacgggtgagttggataaattataaaacatataaattcaaaattggcagatagaatcaccaagtatctatcctcttttactttcaaatgaggaattttgtttttctgaattacacagatcatcacttcctatttcctgttctggacctgtataaaaatgtctacacagtagaagtgacatcaaggtttaataagtatatcaatgattggcacatataaaaattgttgaaccacatactctgaacttggctaatttagttactgcaaggcctccattatccagttttattttttacacgattgaccttgccttgtagctggtgctgtgtagacctgtgttgaaaacacaatcggaatatatgaataattgaataaacagcattatggtgaggcagagacacatggagaagtgttaaaaaaaaaatgggcttcctgcctttctgcctcttttttatgcagtcatctatgttacatctatcctgcctaagaaaaagctgcacatcctaccttcagagtacaaaaaggtacatctgagactcaagactctcactgattggagagcttgtggaaaacaaaacacaccatgccaataaatgagatgaaaacttgagtttgcctttttaactatttatgttctaagttaagctttgataacattcaaatgtcaaattctctcattcttataaaaagttgaattaattgcctgtatttattttagcaattattcaatgtatttccagtataggatgtatagtataattaattttttgtaaataaaatatttttgataaga

SEQ ID NO: 14010 - DNA, 1706 bp, Homo sapiens
agacccccttaagttggaggaggcagaagggcaacaacggcggggaaggagaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttcc

SEQ ID NO: 14011 - DNA, 1163 bp, Homo sapiens
ggaggggcatggagccgccgcgggcctgctgagctccggagcgcggcagccggcggcacgatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagcccccagggaaaggtatggcagtagaggatgaccaggtccaagctgcccaggtcagagctacggaagcatggtccgttcaccaacgccacgtttctagagagcagtgagctgattctccaatggtgagcaggggactacatgtgaactgggacctgcaggccaatgtatccctgaggaaaagtccacaagaacaattcaagaaactagtaagaaacaatgggcagaaagctgtgggacgaaagcacagcaggcttctgggaggctggagatcctttctctcaagggcaggattattcccacctgccacagttcacatgccacaaataacatctcaccttcagtcaagaaaaacgcaaaggaaaaa

SEQ ID NO: 14012 - DNA, 4220 bp, Homo sapiens
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 14013 - DNA, 2517 bp, Homo sapiens
ttcctccaggagtctctggtgcagctggggtggaatctggccaggccctgcttaggcccccatcctggggtcaggaaatttggaggataaggcccttcagccccaaggtcagcagggacgagcgggcagactggcgggtgtacaggagggctgggttgacctgtccttggtcactgaggccattggatcttcctccagtggctgccaggatttctggtggaagagacaggaaggcctcccccccttggtcgggtcagcctgggggctgagggcctggctgtcagccactcttcccagaacatatgtcatggcctcagtggctcatggggaagcaggggtgggcgagcttaggctagagcaagtcctgtgggagatggcagaggcctggtctgagaggcaactcggatgtgccctccagtggccatgctcccctccatgcgtctcccctgccctcctggagccctgcaggtcaatgtttaacagaaaccagagcagcggtggattaatgcgcaagggctcagccccccagccctgagcagtgggggaatcggagactttgcaacctgttctcagctctgcctcccctggccaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactt

SEQ ID NO: 14014 - DNA, 2324 bp, Homo sapiens
agatgtggggagcgcctctgccctgtcgccccgtccgggatgtgaggagcgtctctccctggccgccccgtctgagaagtgaggagcccctccgcccagcagccgccctgtctgagaagctagtcttgaattcctgacctcaggtgatcctcccgcgttggcctcccaaagtgctgggattacaggcatgagccaccactcctggccccagaaagtgacattctttacttaccacaggaggaaaagatccacgaaagtaaagtgcctagggcccatcaatgtcagatgcagccacgtggacaaagaacactccctgagcacaagacacgaaagaacccggtctccagtgtcacaaacaggcctgcccagcagggtctgcccctgcccacctcctccagcctaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgattt

SEQ ID NO: 14015 - DNA, 1522 bp, Homo sapiens
cttcctccaggagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatag

SEQ ID NO: 14016 - DNA, 2081 bp, Homo sapiens
gggtggggtgaccccctacaaaagctcagaatttccagcagcggctccttcctccaggagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactta

SEQ ID NO: 14017 - DNA, 567 bp, Homo sapiens
ccttcctccaggagtctctggtgcagctggggtggaatctggccaggccctgcttaggcccccatcctggggtcaggaaatttggaggataaggcccttcagccccaaggtcaatgtttaacagaaaccagagcagcggtggattaatgcgcaagggctcagccccccagccctgagcagtgggggaatcggagactttgcaacctgttctcagctctgcctcccctggccaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattg

SEQ ID NO: 14018 - DNA, 666 bp, Homo sapiens
cttcctccaggagtctctggtgcagctggggtggaatctggccaggccctgcttaggcccccatcctggggtcaggaaatttggaggataaggcccttcagccccaagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgat

SEQ ID NO: 14019 - DNA, 561 bp, Homo sapiens
tttttgtatttttagtagagaaggggtttcaccatgttagccgggatggtctcgatctcctgacctcgtgatctgccacctcggcttcccaaagtgctaggattataggcgtgagcctccgcacctggcatgcctggccatattttaaaatattttttttaaggaggaaaagatccacgaaagtaaagtgcctagggcccatcaatgtcagatgcagccacgtggacaaagaacactccctgagcacaagacacgaaagaacccggtctccagtgtcacaaacaggcctgcccagcagggtctgcccctgcccacctcctccagcctaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctg

SEQ ID NO: 14020 - DNA, 1084 bp, Homo sapiens
cttcctccaggagtctctggtgcagctggggtggaatctggccaggccctgcttaggcccccatcctggggtcaggaaatttggaggataaggcccttcagccccaaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgat

SEQ ID NO: 14021 - DNA, 2055 bp, Homo sapiens
attctggagggaaacagggtcaaggcgatctcctcccccacgcctgttcctggccctttcctctcagggggcagcaggaagtgaggagaaagggctgggatgggaggcgggagcggatgggagggaatggggtttatcaagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgcttgga

SEQ ID NO: 14022 - DNA, 2136 bp, Homo sapiens
atttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgc

SEQ ID NO: 14023 - DNA, 301 bp, Homo sapiens
ggtggcggtggagggaagggccgggcggccggcgccgccgtgggaggtccgctgcccctttgtccctacggggcctcctccaagccgggagagtgtcagcgctcgagagaaattcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtgg

SEQ ID NO: 14024 - DNA, 550 bp, Homo sapiens
ctcccggcagcgttccttccagtttcgtagcctcttgacgagctgttccctgctttacccaaatgctgtcgtttctctggatcaagggttcttcacggtgtacagggtgggcatcagctgttcagggttctctgaaaccatgtactggatgttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtgga

SEQ ID NO: 14025 - DNA, 357 bp, Homo sapiens
gagctgttccctgctttacccaaatgctgtcgtttctctggatcaagggttcttcacggtgtacaggttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgacc

SEQ ID NO: 14026 - DNA, 571 bp, Homo sapiens
agcagctggcgcaagtagcctagctggagaggctcaccccaggaaggagggaggccaccgacctactgggccgacggactcccacacagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccat

SEQ ID NO: 14027 - DNA, 2318 bp, Homo sapiens
gggtttatcaagtcctcggcgagctgcccaacgggcagcagctggcgcaagtagcctagctggagaggctcaccccaggaaggagggaggccaccgacctactgggccgacggactcccacacagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaat

SEQ ID NO: 14028 - DNA, 4054 bp, Homo sapiens
gaatggggtttatcaagtcctcggcgagctgcccaacgggcagcagctggcgcaagtagcctagctggagaggctcaccccaggaaggagggaggccaccgacctactgggccgacggactcccacacaggtgagcccagagcagacggctggtctgcacccccacagatgcgctcgcagttgcactccctccctctcctggcgcccgggagggttaggggctggtggtgcagacgcgggcccttttgggagttgagtctcgcacaagggagcggacctaggaagagccgaggtggtttcgcacggggctcgccagggtctaagcctgccccccaccgggagaggcctgtggagcgtagggggcgctggatacgggatggaggccctgggagacccctcttgctggctttctcggaggtccagccagaaactgctgcaaggaatggaggcctcctcggggttgagagggagccgggctcccaaaggacctcagagactgggcagaaaaggacgggatctcagggatgactgtcccgccctgatgcgagtcagggagaggggcggccaacctcctagacccctctgagcttccctgaccccaaccctgcggccacgccgcgacccagagccgggctgccaggataacgactgcctcggcccttcctgggccggctaagaagcggtgcttggccccttccctcagtctggcagggggcggggcctccctttagacggcggaccagagaagggggcccctgattcgtgggaggcggggcactactctccaggagaccagaggtcgcctcaggtcaaagtccctttttccacacaaaggggacccacggctggcgtctacgttagggggtgcagagccagatctggtgctgccccctgccaacctcggagtaccacagcacctcctgatggccgaacggggcaacgcctcctcctattcccccccccccccttcccgtccccctgccttgtccctcacactgtctctttaaagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgaggtgagggcgggcggtgcaaacctggcggctctctccccttgggctggggtctgaatccccgggggtgctcgcggagaggcgtcccagaaaccccacccccacccgaccgggcgcaggccccacgtgtggggcgggggcggggtcccgcacaaagacccggcggagcgcgctctagccctgagcggccgggcgggggaggcgagcgcgcgcattcccggtggcggtggagggaagggccgggcggccggcgccgccgtgggaggtccgctgcccctttgtccctacggggcctcctccaagccgggagagtgtcagcgctcgagagaaagtccggagagcctcactcttctgccgggcgagtgttacacggatagaagcctcccggcagcgttccttccagtttcgtagcctcttgacgagctgttccctgctttacccaaatgctgtcgtttctctggatcaagggttcttcacggtgtacagggtgggcatcagctgttcagggttctctgaaaccatgtactggatggtatgcaggcatatatgtgactctggtgagcccaaattatctagttcttagaagggtcacagacctaatagagatttgtgccgagccacaggctacctgctccagaaaagagccctgtgcttctggcagtgagttcccagggtgccttgtctgccctgcagtggcctgtggtctctcaaacctattacagccatgagcacagtgcccccacacagcatgggctttgggagcatagatgggcttgaggtgggcacttccagtattccctagactgacttgttctccccaacccttcttccagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgcttggattttgt

SEQ ID NO: 14029 - DNA, 745 bp, Homo sapiens
acaaagacccggcggagcgcgctctagccctgagcggccgggcgggggaggcgagcgcgcgcattcccggtggcggtggagggaagggccgggcggccggcgccgccgtgggaggtccgctgcccctttgtccctacggggcctcctccaagccgggagagtgtcagcgctcgagagaaagtccggagagcctcactcttctgccgggcgagtgttacacggatagaagcctcccggcagcgttccttccagtttcgtagcctcttgacgagctgttccctgctttacccaaatgctgtcgtttctctggatcaagggttcttcacggtgtacaggttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacatt

SEQ ID NO: 14030 - DNA, 1942 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgc

SEQ ID NO: 14031 - DNA, 1635 bp, Homo sapiens
gaccaaagggtgcggctgctgcagaggtggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgc

SEQ ID NO: 14032 - DNA, 959 bp, Homo sapiens
gcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctag

SEQ ID NO: 14033 - DNA, 545 bp, Homo sapiens
aaaaggcccaagagacccctggggaaacatgctttccccagctcctcctgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacct

SEQ ID NO: 14034 - DNA, 1402 bp, Homo sapiens
ccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtc

SEQ ID NO: 14035 - DNA, 636 bp, Homo sapiens
ccagaggccagcatcaacatgctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtc

SEQ ID NO: 14036 - DNA, 2407 bp, Homo sapiens
tctttattttatttatgctatctatttcttttccttttttttttttttttttttttttgagatgaagtcttactctgttgcccaggctagagtgtagtggtgtgatctcggctcactgcaaccactgcctcctgggttcaagtgattctcctgacttaacctcctgagtagctgggactacaagagcatgccatcatgcccagctaatttttgtatttttagtagagatggggtttcaccatattggccagaatggttttgcattcctgacctcaagtgatctgcctgcctcagcctcccaaaatgttgggttacaggggtgagccaccgtgccttgctatttatgccatctatttcactgaagattccgcctctcatttcttgagtcattttttttaaatttccttaaattggacttcacatttttctgatgcctccttgtttagcttaataactgaccttctgaattcttttttaggaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctccttattggaatatttaagttgcatttaaactaaaactagtataatttagtcttttcatgaatgtacatacataaaattatacataaaaatattaaattattcatttcaaa

SEQ ID NO: 14037 - DNA, 1616 bp, Homo sapiens
ttgtctgaaccacgcacaggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggc

SEQ ID NO: 14038 - DNA, 314 bp, Homo sapiens
ccagtgagatgaaccaggaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaa

SEQ ID NO: 14039 - DNA, 589 bp, Homo sapiens
tatccgagggcctttgggccattatgctgtgaatgtgacatctgcagccaagctctgcagtcagagtctatgtaacaatcatggaagagtattcgaaaaacacctgagtcctccttctatctgcatatgcctgaaagcagtgtcaggtccctcagctgcaggtctgttggagtttgctggaggtccattccagaccttgtttacctgggtatcaccagcggaggctgcagaaccgcaagaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataa

SEQ ID NO: 14040 - DNA, 15719 bp, Homo sapiens
gcatggagagtgcgggcggcttcaagctgggtatggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggatagtgaaagagaagctggtgtgccacgccatcatcggggcacagaaggggaagagcttggtgatggctgtgaacatcacctgtgagttcgtcgcacctctcatccagctctccaccaagcagctcatctaccgactggagaagaaacctaacagtatcctgaaacctgattaccagcccttggccataaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctgaacaactgggtggcagaagaaattctagcaattaagtatgtggaacaccctcagatagacagcctggacctgcgcggagaagtgcattaccccaacctcagctttgagacaaaggagctggattttggctgcatcctgaacgatactgagctcattcgctacgttaccatcaccaactgcagtccgttggttgtgaagtttcgctggttcttcttggtgaatgatgaggaaaatcagataaggtttgtgacattgccgaagaagccctacagtgccccagtgtcccagatggagtccatcccagcaacctcagaggctgccagcccaccagcaatcctagttacagtagagtcccccgagatggatttaaatgattttgttaagactgtccttgtggatgaagatgccaggcctgaagaaaaagaactaagaaaaacgaaagcttccagtgtgatctcagatgaaataaaaattagctctactgaaatagaaagaatatactcaagccagagccaggtggaggatcaggaatccctacagacctgtgaacagaatgagatgctttccattgggatagaagaagtgtttgatattttgcccctgtttggagtgttgcagccacacagtagccaccaaatatcgttcaccttctatggacacgctaacatcattgcacaagctaaagctctgtgtgaagtggaagaaggacccacctacgaaataacactgaagggagaggcgtccctggtcaactattcctttgacaccaaggatattcactacggattacagctgtttgaccatgtcacagagagggaaatcacgctgacgaacatggggaaagttggctttgagttcaaggttctgactgaccaccagtcttctccagacaaccttctccctggagtgccactaatcctgcctgtgtctggctttatcagttcacatcaagagcaggtattaaaagtttactacctacctggagtacctgaggtctttaaaaggagtttccagatacagatcgcccacctggacccagaaaatatcactctgagcggagagggaatctttccccaaatctgcctcgatctccccaggaacctcacagcaaatgaaaagtatgaaatgttcttgaatcaagccaggaaaaacacagacaaagagtataacaaatgtgaaatgctcgatcactttgacataataactgaggaagtgccagaagacgagcctgctgaggtaagtgctcatctccagatggaggtagaaagacttatagtccaaagctatgtcctagaacatcagaaaacaaccacccctgatcctatggatgacccctgcttcagccatcggagtcgccgcaaactggccaaaatccagctaccagagtacatcctggactttggctacatcatccttggcgaagtccgaacccacatcatcaagatcatcaacaccagtcactttccagtgtcattccatgcagacaagcgtgtccttcatgagacaggattcagtactgagctagatcgtgtaaagaatctacctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcatgggacacccttgtcaggaaagtcagccaatgccgttagcgtggccaagtactacaacgcagcctgcctgagcatcgactccattgtgctggaagctgtggccaacagcaacaacatcccagggatccgggcccgtgagctctgcatcagggctgccatagagcagtccgtgaaggaaggagaggaggctgcccaggaggcagctgtgggtcaaaacgtcatagggcaaggacgactgagcactgacaccttgggcaagttagcctccgagatgactctggtggccccagaaattaaacctggaaagagtgttcgtgggagcgtggtgatcaccaaaagcaaggcagacagccatggctccgggtcacagaagcagcatcactcacaccagtctgaaacaccacagatttcctccagccctctccccccggggcccatccaccgctggctcagtgttagtcccagtgtcggaggcgagaccgggctgatgagctgtgtgctcccggatgaacttctcgtgcagatcctggcagagcggatacagctgagtgactgctaccgaggagtggtgtttgatggcctcgacactctctttgctcagaatgctgcagccgccctcctctgcctgctgaaggccattggcagccgggagcatatatacattctcaacatggcccaggattacgcagccatgaaggcccaggagaaagccaaaaaggagcaagaagaacgcaagcacaagggagctcttgagaaagagaaggagcgtctccaaaacatggatgaggaagaatatgatgccctgactgaggaggagaaactcacattcgatcgggggattcagcaggcgctccgcgagcggaagaagagggagcaggagaggctggcaaaggaaatgcaagaaaagaagctacagcaggagctggagcgacaaaaggaagaggatgagctgaaacggagggtcaaaaaaggaaagcagggacccattaaggaggagccccccatgaagaaatctcaagcagcaaacaagcaggttcctccgctcaccaaagtggatgtcaagatggagacaatcgaaaggaaaatatctgttagggaacaaacaatgtctgagaaggaagagctaaataagaagaaaaggaacatgggcgatgtcagcatgcatgggcttcctcttgtccaggaccaagaggacagtgaaggggacaactcaaaggaccccgacaagcaactggccccgaagtttaagacctatgaattgacactgaaggatgtccagaacatcctcatgtactgggaccggaagcaaggagtccagctgcctcctgcagggatggaggaagcgccccatgagcccgacgaccagcgccaggtccccttgggtgggcgcaggggccgcaaggaccgggagagagagcgcctggagaaggagcgcacggagaaggagcgcctggagagggagaaggcggagcgggagcgcctggagaagctgcgagccctggaggagcggagcgactgggagggggaaggggaggaggaccacgaagggaagaaggagaaggacctgggcgtacccttcctagacatccagacaccagactttgaaggcttgagctggaagcaggccctagagagcgacaagcttcccaaaggagagcagatcctagacatcttgggtctgggtgcctccggaccacccatcccgcctcccgccttattctcaatcgtctcctacccggtgaagcggccacctttgaccatgacagacgacctggagcattttgtatttgtgatcccaccatccgaagatatatctctggatgaaaaaaaagaaatggaaatagaatcagactttttggccaccacaaacactacaaaggctcaagaggagcagaccagctcatctaaggggggcaaacagaaaatgaaagaaaagatagaccaagtcttcgagattcagaaagacaagcgtcacatggccttaaacaggaaggtcctttctggggaacctgctggaaccatttcccagctgtcagatacagacctggacaacttcaacgggcagcactcccaggagaaattcaccagactgaatcacttccggtggatcgtgccagccaatggcgaggtaacgttgcaggtgcacttctcttctgatgagttcgggaactttgaccaaacctttaactttgagatcctaggaacttgctgccagtaccagctctactgccgaggcatctgcacttacccatacatttgccaagacccaaaagtggtatttcctcagcggaagatggacatgaagacaaatgaggtcatctttaagaagtatgttatgagcacggagacgtactactttgggccactactttgtggaaaatcaagagataagtacaagtcatccttattcccaggcaacatggagacgctaacaatcctgaacacttccttaatggtggtggaggcatccttctattttcagaatgatgtcaaagcaaacacgtacttcctggaacccaacaccatggtcctgaaacccaatgagaagcagatattaaacgtatgggcctaccctacttcagttggtgtctttgaagacagcattgtctgctgcatcaatgacaacccagagccagccatcttccaattaagctgccaggggatccgcccggaactagagctggaacccaggcaattacattttgaccggctcttgctgcacagacaggaatccagggtagttcttctccgcaatgtcacgctcctgcctgtggcctggcggatcaccagcctggagcacttgggtgatgatttcactgtatccctgatgcaggggaccatcccccctgaggctgagtacggcctgcacctgtactttcagcccaccaagcctgtcaacatcaagaaggctattcggttggaggttttagatgcagaaaatcttcttggtgttgttcagattgaaaatatcatggtctttgcagaggcatacgacatcgccttggacatcaccttccccaaaggagctgaagggggactggattttgggattgtcagggtcacagaggaggcgaagcagcccctgcaattgaagaaccgtgggaaatatgagatcgcgttcagcttttccgtggactctgtagggatttcaacacctaatataaattccatgatctcagtccaacccaaaaagggttcactgaccccaacagaaaaacccacaaatgtccaagttttcttccatgcaaaaaaggaagtgaagattgagcaccagcctgttctgcgctgtcagattattgagcccaatatttcagaaggaggtgagatcattgccagcatcccaattaagttttccgcgaatgcagtatattccaaatacaacatcaccccctcctctgtcatcaactttggagctttgatctgtggcactcgtaaaagcaccaccttcaccatagaaaatcaaggtgttactgacttcaagttcgccctttataagctgacaggggagagccccattcatcaaaagaaagcagccagccacgtcagacatgcaagatcccgagaaagtgagagcttctacaaaactggctcttccagagcagccaagttctctgacacgattcagaaagaagtaaccaccacaggccaggcccgcttcgcccatggcatgttcaccgtgtaccctgggtttggctccattccttccggaggacagcaggtcatcaacgttgactgtgtggctgacgccatgggaaagtgtgaggagtttatagccatcgatatctccggccgagaccctgcagtccaccctgccggcattctttacactttgctagctgaagcctgtctaccagccttcgtgaccgaaaacaatgccttgatatttgaagagcaccagatatgtaccagtgccaacctgcaccacatcctgcagaccatagagagcggggggctgttcgtcgaggatgagaacaagttcatcttctgcaatgtcctggtgggccgccaagccaaggctcgtttcaagatcagcaacgtgggaaagatcacctgtgatgtcaacattgtagtcaggcctatctccaataagccctttgcccgcatcgtcgacatttttgaagtggaacccagcaagatgtgcattgccagtcattcccatgcctttgccacggtgtccttcaccccgcagatcatgcagaactaccagtgcatctttgaggctaccttggatggcttgcccagcaccctggccaagagccgaggcctcgtgtttgacatcgctggtgaggggaacctccctcgagtgacggttgtgcggccagttcttcataaccaatatggaaaccccttgctcctctttaagaggcttctccttggtcattcagagaagctgcctctcatcctcaagaacaatggtgtcctccctgcccagctgcatgttgacctgcaggatgagctaggagtcttctccctgaaagggaggcccaccaccgcgtatatctacatcacagaggaaaataaaccacatgtaaaagcaaagaaagctcacacagcctccttggttgtttctcctggagatacagctgaatttgatgtcgttttccactcccagaaggttgggaggatgagaggtatcatccacttgtcagtgatcaacaaccaatatgaggagacctccatccacatggtgggagagggctatgaggatgacatcaccttggacaacatccatggactggtggcccccaccagccaggaagacataagtatctctgagttcacagagatcatcgaggacaatgatatggaagacttggtggcagctgctctggtggaccacatccaatttggggactgccacattggacacagctataatgcgagcttcacagtcacaaatcacagccaagtgaacttgatacggtttgaatggcctgtttcagctacaattgctttctccccacagatgggccacctccaccctgggtgtgccaaggacatagtggtgaccatgaagtcagatgtacccatcaacctaaagaatatgcggatcaggtgcaagctctccaggattatgtttcagctccctgcagaccaggtccccgactgggatgaccgcatgcacacagtcaagtgggtggacgtacccagaaacatgcctgggactttcactacaaaacgaaaagtgatagagacggatccggaacctgctcactcagtactagaagaaaactaccaagaactgcagcttcaaatcagtgccaatgtggatttcgcttcataccattgccaagcaagagatgtgcgctttaaggaaaccttggtttaccagacccgagtgtttgagttcgatgtgattaattcaggacgtgtccagctggaattcagctgggtctcagaagatacctcaaaggcagtcagctttgcaaaaccagatcaccaaggttcagctcaaaaagatcagcttagtcagggcacgatgcatacaggcagcaccctggacagcaccatggaccactgggccgagggttccccacagcccttctctgtggagccctcttcgggaatcgtgccggtggggaagattcagaagttcaaagtaaaattctccccgttggacattggagacttcgagagcaaccttttctgccagattcccaacctgccacctggagagcaaggtccggtcctggtagcaaaagggcggagcaccttgcccatctgccattttgatctgaaagactcggactacataagtggccatcagcgcaacccagagctccgagggtccagtgggggagctctggatccaaacacccgggtgattgagttcaccactgtgggcataggagggaagaatctccggacctttaccatcctaaacccaaccaatagcacctactccttctgctggatctctgaagaaattgaaagtctccagaaccctgcagcattcacatgccttacagaaaagggcttcatccaccctgaaaagaaagccgagatcgtgttccagttcacacctttccatctgggcatcactgagtcatcatggaccttcctaattcccgagcacaacatcacagtccctttcctgctggtaggcaaaactaccgaacctctcatctctctgaacaagtcacacctcaacttcagctctctcctcattggcagagaagccagggagactgtgcagatcattaacaaggaggagcaggggttcgatttttccttccaggacaactcccgctattctgaaggtttcagcaacagcctgcttgtatgtcccatggaaggctggatcccaccactgtccaggttcccaattgatattttcttcacaccaaagcaggaaggagatgtgaactttaatttgatctgcaatgtggaaaagaaagtccaccctgtgacattaaatgtcaaggccgagggctacactatgaatgtggagatcaagtgcaaggacaggacaggctccatcactctgttgactcccaaccagactaacatcatcaacttctatgaggtggagttaaatgaatgtgtccagtgtgaattcaactttatcaacactggaaagttcaccttcagcttccaggcacagctgtgtggctccaaaaccttgctgcagtacttggaattttcacccatcgacagcactgtggatgtaggacagagtgtacatgccaccctgtcttttcaaccattaaagaagtgtgtcttgacagacctggaactcataatcaagatcagccatggtccaacatttatgtgcaacatctcaggctgtgctgtgagcccggctatccatttctccttcaccagctacaactttgggacctgctttatctatcaagctgggatgcccccatacaaacaaaccctggtaattaccaacaaggaagaaacacctatgagcatagattgtctgtacaccaacaccactcacctcgaggtgaactcccgtgttgatgtggtaaagccaggaaacacattggagattccaataactttttatcctcgagaaagtatcaactatcaagaactcattccctttgaaatcaatgggctctcacaacaaacagtcgaaatcaaagggaagggtaccaaaatgaagattttagtcctagatccagccaacaggattgtgaagttgggagctgtcctaccagggcaggttgtgaaaagaacagtttccatcatgaacaacagcctggcccagctcacatttaatcagtccattctgttcacaattccagaactccaggaacccaaggtccttaccctggcgcccttccacaacatcacactgaagcccaaagaagtctgtaaactggaagtcatctttgccccgaagaagcgtgtccctcccttctctgaggaagtgttcatggaatgcatggggctcctgcgccccctcttcctccttagcggctgctgccaggccctggagatctcactggaccaggaacatattccctttggacccgtggtgtatcagacgcaagccacacgtcgcatcctcatgatgaacacaggcgatgtgggtgcaaggtttaaatgggacatcaaaaaatttgagcctcatttctccattagcccagaagaaggctatattacctcaggcatggaggtttcttttgaagtgacctaccatcccaccgaggtgggaaaggagagcctttgtaaaaacattctctgctacatccagggaggcagtcctctgagtctaaccctgtctggagtctgcgtgggaccacctgcggtaaaagaggtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagagattccgggtcatcgtggaaatactgaaaccagagaagccggacctaagcatcactatgaagggccttgattacattgatgtactgtctggctctaagaaagactacaagctgaacttcttttcccacaaggagggaacgtacgctgcaaaggtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacggaatgccggatgcccgacatcgccctgccctcccagtttgtggtgcctgccaactccgagggcacgttctcatttgaatttcagcccctgaaagctggagaaaccttcggaagactaactttgcacaacactgacttgggttactaccaatatgagctctatctgaaagccacgccagcacttccggaaaagcctgttcacttccagactgtccttggcagcagccaaatcatccttgtgaagttcatcaattacacacggcagaggacagaatactactgcaggaccgactgtacagacttccacgcagaaaaactcattaatgcagccccaggaggccagggaggcactgaagccagtgtggaagtcttattcgagcccagccacctgggtgagaccaagggcatcctgatcctatcatcgctcgcaggtggagagtatatcatccccctctttggaatggctctgcctcccaagccccaaggtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttagtggtaaccagggttacctgtatcaaccaaaagctatgcattgtcttagcctgaaaaagaatagagaaaacaataagaattctaaaggaactgtttttattcttctcatacaattatagggcagttatttccctattatgtgttttccaaatatagatatgaaatatctattccatattaaacattataactacacacaacag

SEQ ID NO: 14041 - DNA, 3152 bp, Homo sapiens
accgtggcaacggacggcaacagctcgggcggcgcatggagagtgcgggcggcttcaagctgggtatggagcccctcagcggcggcggggtctgtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttaggtaaggaaatctcatggaccagtttttatagatatcacatatgttacatatgctgagcatcacctctactttagaaaattattttaagtaattaaaactagccacctcagtccctctcctttcccatcctcactcttccacctcctgatgtgtatgtcagcaacaagaagacattttctagccataacttggttgcattctctaatccgtgtccctctacatccgagaagaatatggtttgtaggaaatgcattcttttctcaaactg

SEQ ID NO: 14042 - DNA, 3058 bp, Homo sapiens
aacggacggcaacagctcgggcggcgcatggagagtgcgggcggcttcaagctgggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttaggtaaggaaatctcatggaccagtttttatagatatcacatatgttacatatgctgagcatcacctctactttagaaaattattttaagtaattaaaactagccacctcagtccctctcctttcccatcctcactcttccacctcctgatgtgtatgtcagcaacaagaagacattttctagccataacttggttgcattctctaatccgtgt

SEQ ID NO: 14043 - DNA, 15480 bp, Homo sapiens
ggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggatagtgaaagagaagctggtgtgccacgccatcatcggggcacagaaggggaagagcttggtgatggctgtgaacatcacctgtgagttcgtcgcacctctcatccagctctccaccaagcagctcatctaccgactggagaagaaacctaacagtatcctgaaacctgattaccagcccttggccataaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctgaacaactgggtggcagaagaaattctagcaattaagtatgtggaacaccctcagatagacagcctggacctgcgcggagaagtgcattaccccaacctcagctttgagacaaaggagctggattttggctgcatcctgaacgatactgagctcattcgctacgttaccatcaccaactgcagtccgttggttgtgaagtttcgctggttcttcttggtgaatgatgaggaaaatcagataaggtttgtgacattgccgaagaagccctacagtgccccagtgtcccagatggagtccatcccagcaacctcagaggctgccagcccaccagcaatcctagttacagtagagtcccccgagatggatttaaatgattttgttaagactgtccttgtggatgaagatgccaggcctgaagaaaaagaactaagaaaaacgaaagcttccagtgtgatctcagatgtacggtgtcctttccatggggaggaaagaatatactcaagccagagccaggtggaggatcaggaatccctacagacctgtgaacagaatgagatgctttccattgggatagaagaagtgtttgatattttgcccctgtttggagtgttgcagccacacagtagccaccaaatatcgttcaccttctatggacacgctaacatcattgcacaagctaaagctctgtgtgaagtggaagaaggacccacctacgaaataacactgaagggagaggcgtccctggtcaactattcctttgacaccaaggatattcactacggattacagctgtttgaccatgtcacagagagggaaatcacgctgacgaacatggggaaagttggctttgagttcaaggttctgactgaccaccagtcttctccagacaaccttctccctggagtgccactaatcctgcctgtgtctggctttatcagttcacatcaagagcaggtattaaaagtttactacctacctggagtacctgaggtctttaaaaggagtttccagatacagatcgcccacctggacccagaaaatatcactctgagcggagagggaatctttccccaaatctgcctcgatctccccaggaacctcacagcaaatgaaaagtatgaaatgttcttgaatcaagccaggaaaaacacagacaaagagtataacaaatgtgaaatgctcgatcactttgacataataactgaggaagtgccagaagacgagcctgctgaggtaagtgctcatctccagatggaggtagaaagacttatagtccaaagctatgtcctagaacatcagaaaacaaccacccctgatcctatggatgacccctgcttcagccatcggagtcgccgcaaactggccaaaatccagctaccagagtacatcctggactttggctacatcatccttggcgaagtccgaacccacatcatcaagatcatcaacaccagtcactttccagtgtcattccatgcagacaagcgtgtccttcatgagacaggattcagtactgagctagatcgtgtaaagaatctacctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcatgggacacccttgtcaggaaagtcagccaatgccgttagcgtggccaagtactacaacgcagcctgcctgagcatcgactccattgtgctggaagctgtggccaacagcaacaacatcccagggatccgggcccgtgagctctgcatcagggctgccatagagcagtccgtgaaggaaggagaggaggctgcccaggaggcagctgtgggtcaaaacgtcatagggcaaggacgactgagcactgacaccttgggcaagttagcctccgagatgactctggtggccccagaaattaaacctggaaagagtgttcgtgggagcgtggtgatcaccaaaagcaaggcagacagccatggctccgggtcacagaagcagcatcactcacaccagtctgaaacaccacagatttcctccagccctctccccccggggcccatccaccgctggctcagtgttagtcccagtgtcggaggcgagaccgggctgatgagctgtgtgctcccggatgaacttctcgtgcagatcctggcagagcggatacagctgagtgactgctaccgaggagtggtgtttgatggcctcgacactctctttgctcagaatgctgcagccgccctcctctgcctgctgaaggccattggcagccgggagcatatatacattctcaacatggcccaggattacgcagccatgaaggcccaggagaaagccaaaaaggagcaagaagaacgcaagcacaagggagctcttgagaaagagaaggagcgtctccaaaacatggatgaggaagaatatgatgccctgactgaggaggagaaactcacattcgatcgggggattcagcaggcgctccgcgagcggaagaagagggagcaggagaggctggcaaaggaaatgcaagaaaagaagctacagcaggagctggagcgacaaaaggaagaggatgagctgaaacggagggtcaaaaaaggaaagcagggacccattaaggaggagccccccatgaagaaatctcaagcagcaaacaagcaggttcctccgctcaccaaagtggatgtcaagatggagacaatcgaaaggaaaatatctgttagggaacaaacaatgtctgagaaggaagagctaaataagaagaaaaggaacatgggcgatgtcagcatgcatgggcttcctcttgtccaggaccaagaggacagtgaaggggacaactcaaaggaccccgacaagcaactggccccgaagtttaagacctatgaattgacactgaaggatgtccagaacatcctcatgtactgggaccggaagcaaggagtccagctgcctcctgcagggatggaggaagcgccccatgagcccgacgaccagcgccaggtccccttgggtgggcgcaggggccgcaaggaccgggagagagagcgcctggagaaggagcgcacggagaaggagcgcctggagagggagaaggcggagcgggagcgcctggagaagctgcgagccctggaggagcggagcgactgggagggggaaggggaggaggaccacgaagggaagaaggagaaggacctgggcgtacccttcctagacatccagacaccagactttgaaggcttgagctggaagcaggccctagagagcgacaagcttcccaaaggagagcagatcctagacatcttgggtctgggtgcctccggaccacccatcccgcctcccgccttattctcaatcgtctcctacccggtgaagcggccacctttgaccatgacagacgacctggagcattttgtatttgtgatcccaccatccgaagatatatctctggatgaaaaaaaagaaatggaaatagaatcagactttttggccaccacaaacactacaaaggctcaagaggagcagaccagctcatctaaggggggcaaacagaaaatgaaagaaaagatagaccaagtcttcgagattcagaaagacaagcgtcacatggccttaaacaggaaggtcctttctggggaacctgctggaaccatttcccagctgtcagatacagacctggacaacttcaacgggcagcactcccaggagaaattcaccagactgaatcacttccggtggatcgtgccagccaatggcgaggtaacgttgcaggtgcacttctcttctgatgagttcgggaactttgaccaaacctttaactttgagatcctaggaacttgctgccagtaccagctctactgccgaggcatctgcacttacccatacatttgccaagacccaaaagtggtatttcctcagcggaagatggacatgaagacaaatgaggtcatctttaagaagtatgttatgagcacggagacgtactactttgggccactactttgtggaaaatcaagagataagtacaagtcatccttattcccaggcaacatggagacgctaacaatcctgaacacttccttaatggtggtggaggcatccttctattttcagaatgatgtcaaagcaaacacgtacttcctggaacccaacaccatggtcctgaaacccaatgagaagcagatattaaacgtatgggcctaccctacttcagttggtgtctttgaagacagcattgtctgctgcatcaatgacaacccagagccagccatcttccaattaagctgccaggggatccgcccggaactagagctggaacccaggcaattacattttgaccggctcttgctgcacagacaggaatccagggtagttcttctccgcaatgtcacgctcctgcctgtggcctggcggatcaccagcctggagcacttgggtgatgatttcactgtatccctgatgcaggggaccatcccccctgaggctgagtacggcctgcacctgtactttcagcccaccaagcctgtcaacatcaagaaggctattcggttggaggttttagatgcagaaaatcttcttggtgttgttcagattgaaaatatcatggtctttgcagaggcatacgacatcgccttggacatcaccttccccaaaggagctgaagggggactggattttgggattgtcagggtcacagaggaggcgaagcagcccctgcaattgaagaaccgtgggaaatatgagatcgcgttcagcttttccgtggactctgtagggatttcaacacctaatataaattccatgatctcagtccaacccaaaaagggttcactgaccccaacagaaaaacccacaaatgtccaagttttcttccatgcaaaaaaggaagtgaagattgagcaccagcctgttctgcgctgtcagattattgagcccaatatttcagaaggaggtgagatcattgccagcatcccaattaagttttccgcgaatgcagtatattccaaatacaacatcaccccctcctctgtcatcaactttggagctttgatctgtggcactcgtaaaagcaccaccttcaccatagaaaatcaaggtgttactgacttcaagttcgccctttataagctgacaggggagagccccattcatcaaaagaaagcagccagccacgtcagacatgcaagatcccgagaaagtgagagcttctacaaaactggctcttccagagcagccaagttctctgacacgattcagaaagaagtaaccaccacaggccaggcccgcttcgcccatggcatgttcaccgtgtaccctgggtttggctccattccttccggaggacagcaggtcatcaacgttgactgtgtggctgacgccatgggaaagtgtgaggagtttatagccatcgatatctccggccgagaccctgcagtccaccctgccggcattctttacactttgctagctgaagcctgtctaccagccttcgtgaccgaaaacaatgccttgatatttgaagagcaccagatatgtaccagtgccaacctgcaccacatcctgcagaccatagagagcggggggctgttcgtcgaggatgagaacaagttcatcttctgcaatgtcctggtgggccgccaagccaaggctcgtttcaagatcagcaacgtgggaaagatcacctgtgatgtcaacattgtagtcaggcctatctccaataagccctttgcccgcatcgtcgacatttttgaagtggaacccagcaagatgtgcattgccagtcattcccatgcctttgccacggtgtccttcaccccgcagatcatgcagaactaccagtgcatctttgaggctaccttggatggcttgcccagcaccctggccaagagccgaggcctcgtgtttgacatcgctggtgaggggaacctccctcgagtgacggttgtgcggccagttcttcataaccaatatggaaaccccttgctcctctttaagaggcttctccttggtcattcagagaagctgcctctcatcctcaagaacaatggtgtcctccctgcccagctgcatgttgacctgcaggatgagctaggagtcttctccctgaaagggaggcccaccaccgcgtatatctacatcacagaggaaaataaaccacatgtaaaagcaaagaaagctcacacagcctccttggttgtttctcctggagatacagctgaatttgatgtcgttttccactcccagaaggttgggaggatgagaggtatcatccacttgtcagtgatcaacaaccaatatgaggagacctccatccacatggtgggagagggctatgaggatgacatcaccttggacaacatccatggactggtggcccccaccagccaggaagacataagtatctctgagttcacagagatcatcgaggacaatgatatggaagacttggtggcagctgctctggtggaccacatccaatttggggactgccacattggacacagctataatgcgagcttcacagtcacaaatcacagccaagtgaacttgatacggtttgaatggcctgtttcagctacaattgctttctccccacagatgggccacctccaccctgggtgtgccaaggacatagtggtgaccatgaagtcagatgtacccatcaacctaaagaatatgcggatcaggtgcaagctctccaggattatgtttcagctccctgcagaccaggtccccgactgggatgaccgcatgcacacagtcaagtgggtggacgtacccagaaacatgcctgggactttcactacaaaacgaaaagtgatagagacggatccggaacctgctcactcagtactagaagaaaactaccaagaactgcagcttcaaatcagtgccaatgtggatttcgcttcataccattgccaagcaagagatgtgcgctttaaggaaaccttggtttaccagacccgagtgtttgagttcgatgtgattaattcaggacgtgtccagctggaattcagctgggtctcagaagatacctcaaaggcagtcagctttgcaaaaccagatcaccaaggttcagctcaaaaagatcagcttagtcagggcacgatgcatacaggcagcaccctggacagcaccatggaccactgggccgagggttccccacagcccttctctgtggagccctcttcgggaatcgtgccggtggggaagattcagaagttcaaagtaaaattctccccgttggacattggagacttcgagagcaaccttttctgccagattcccaacctgccacctggagagcaaggtccggtcctggtagcaaaagggcggagcaccttgcccatctgccattttgatctgaaagactcggactacataagtggccatcagcgcaacccagagctccgagggtccagtgggggagctctggatccaaacacccgggtgattgagttcaccactgtgggcataggagggaagaatctccggacctttaccatcctaaacccaaccaatagcacctactccttctgctggatctctgaagaaattgaaagtctccagaaccctgcagcattcacatgccttacagaaaagggcttcatccaccctgaaaagaaagccgagatcgtgttccagttcacacctttccatctgggcatcactgagtcatcatggaccttcctaattcccgagcacaacatcacagtccctttcctgctggtaggcaaaactaccgaacctctcatctctctgaacaagtcacacctcaacttcagctctctcctcattggcagagaagccagggagactgtgcagatcattaacaaggaggagcaggggttcgatttttccttccaggacaactcccgctattctgaaggtttcagcaacagcctgcttgtatgtcccatggaaggctggatcccaccactgtccaggttcccaattgatattttcttcacaccaaagcaggaaggagatgtgaactttaatttgatctgcaatgtggaaaagaaagtccaccctgtgacattaaatgtcaaggccgagggctacactatgaatgtggagatcaagtgcaaggacaggacaggctccatcactctgttgactcccaaccagactaacatcatcaacttctatgaggtggagttaaatgaatgtgtccagtgtgaattcaactttatcaacactggaaagttcaccttcagcttccaggcacagctgtgtggctccaaaaccttgctgcagtacttggaattttcacccatcgacagcactgtggatgtaggacagagtgtacatgccaccctgtcttttcaaccattaaagaagtgtgtcttgacagacctggaactcataatcaagatcagccatggtccaacatttatgtgcaacatctcaggctgtgctgtgagcccggctatccatttctccttcaccagctacaactttgggacctgctttatctatcaagctgggatgcccccatacaaacaaaccctggtaattaccaacaaggaagaaacacctatgagcatagattgtctgtacaccaacaccactcacctcgaggtgaactcccgtgttgatgtggtaaagccaggaaacacattggagattccaataactttttatcctcgagaaagtatcaactatcaagaactcattccctttgaaatcaatgggctctcacaacaaacagtcgaaatcaaagggaagggtaccaaaatgaagattttagtcctagatccagccaacaggattgtgaagttgggagctgtcctaccagggcaggttgtgaaaagaacagtttccatcatgaacaacagcctggcccagctcacatttaatcagtccattctgttcacaattccagaactccaggaacccaaggtccttaccctggcgcccttccacaacatcacactgaagcccaaagaagtctgtaaactggaagtcatctttgccccgaagaagcgtgtccctcccttctctgaggaagtgttcatggaatgcatggggctcctgcgccccctcttcctccttagcggctgctgccaggccctggagatctcactggaccaggaacatattccctttggacccgtggtgtatcagacgcaagccacacgtcgcatcctcatgatgaacacaggcgatgtgggtgcaaggtttaaatgggacatcaaaaaatttgagcctcatttctccattagcccagaagaaggctatattacctcaggcatggaggtttcttttgaagtgacctaccatcccaccgaggtgggaaaggagagcctttgtaaaaacattctctgctacatccagggaggcagtcctctgagtctaaccctgtctggagtctgcgtgggaccacctgcggtaaaagaggtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagagattccgggtcatcgtggaaatactgaaaccagagaagccggacctaagcatcactatgaagggccttgattacattgatgtactgtctggctctaagaaagactacaagctgaacttcttttcccacaaggagggaacgtacgctgcaaaggtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacggaatgccggatgcccgacatcgccctgccctcccagtttgtggtgcctgccaactccgagggcacgttctcatttgaatttcagcccctgaaagctggagaaaccttcggaagactaactttgcacaacactgacttgggttactaccaatatgagctctatctgaaagccacgccagcacttccggaaaagcctgttcacttccagactgtccttggcagcagccaaatcatccttgtgaagttcatcaattacacacggcagaggacagaatactactgcaggaccgactgtacagacttccacgcagaaaaactcattaatgcagccccaggaggccagggaggcactgaagccagtgtggaagtcttattcgagcccagccacctgggtgagaccaagggcatcctgatcctatcatcgctcgcaggtggagagtatatcatccccctctttggaatggctctgcctcccaagccccaaggtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttag

SEQ ID NO: 14044 - DNA, 3685 bp, Homo sapiens
gcatggagagtgcgggcggcttcaagctgggtatggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcagc

SEQ ID NO: 14045 - DNA, 2340 bp, Homo sapiens
ggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgccacacaggaactgagagatcctcaagtactgattccctttcagcggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaagtgctccagagttatgcaataggaaggtgatgctgtcagtcctgcagtggaagatccatagagccaagaggtccctgccccgggacactgttgctgtgacttga

SEQ ID NO: 14046 - DNA, 3762 bp, Homo sapiens
ggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggaaacctaacagtatcctgaaacctgattaccagcccttggccataaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctgaacaactgggtggcagaagaaattctagcaattaagtatgtggaacaccctcagatagacagcctggacctgcgcggagaagtgcattaccccaacctcagctttgagacaaaggagctggattttggctgcatcctgaacgatactgagctcattcgctacgttaccatcaccaactgcagtccgttggttgtgaagtttcgctggttcttcttggtgaatgatgaggaaaatcagataaggtttgtgacattgccgaagaagccctacagtgccccagtgtcccagatggagtccatcccagcaacctcagaggctgccagcccaccagcaatcctagttacagtagagtcccccgagatggatttaaatgattttgttaagtaa

SEQ ID NO: 14047 - DNA, 3659 bp, Homo sapiens
aagctgggtatggagcccctcagcggcggcggggtctgtgagttggacgcggggtcttggcggggaatggaggtagaataaacgtgggacccggagtgcaccaagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcagcaa

SEQ ID NO: 14048 - DNA, 1634 bp, Homo sapiens
acggggcgggacgggctgggccggacctgctctgaggctcccagtcgcagcggtgaccgcgggcgggtggggcgccgggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 14049 - DNA, 2189 bp, Homo sapiens
ggtgaagaaaccaagacgcagagaggccaagccccttgccttgggtcacacagccaaaggaggcagagccagaactcacaaccaggtctgtgtcccctaagtcctcggatgcatcgtccctgccccgctgccctcccgggagattgtaggagagaagcaggggcagaggcagtgctggatgtcccgggagaaggctgcaatgagcaggcccagccatccctgaaggaggagccccggggaagcaaactcttccctagaaacactttaaaagcacccacctgttggagacagagatgctgaggaacaagagtgattggggccagggtaaacgccaagacagagaggggagagcagttcctcagtggaactccctccaacattgcccccaccacttttaccagtgctgggtgtgggggatcttgcaggctcagcttcgtgacttggcctgtctctgcctcagtttccgcatctgtcccatgaggttaagcatgtacctacctcgcaggattgctgagaagatgatataagatgcttggtgtacaggcttagcccctggcaccaggttactaccaaaagttcatggttccagtgcttcctccaccctccgtcctgcccctctgagagtacttctctgtcctgggcacctttaacttcaggttgttcagggctatctgagatctgcaggatttccggacagccccaccagcaactaggagctgcttgagtaagaccaagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaa

SEQ ID NO: 14050 - DNA, 539 bp, Homo sapiens
gcttctttcccagcctgcctcctggaggtgaacatgtgcaggtggagaagtgcccactgcatcggggccaaaagagagaacgctgcctacctcaccccaacggcatttgaaagtagactggctcatctgaaatgcttatttgcaagcatctaacttcctgaccctgtgtcacagatggccccacttggccccaagcccctggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctg

SEQ ID NO: 14051 - DNA, 1810 bp, Homo sapiens
aatcctcacattttgggagggaggccaaggcgggcagatcacctgaggttaggagttcaagatcagcctggccaacatggcgaaaccctgtctctattaaaaataccaaaattagctgggcatggtggcacgcgcctgtaataccagctactcaggaggctgaggcaggagagtcacttgaacccgggaggcggaggctgcagtgagtcgagatcgtgccactgcactccagcctgggcgacaagagcgagactctgtctcaaaaaaaaaagagtggttaacaagcatgatgatacaaccagttgaaagcaatatttgagttcataaagaagttgatgagttgataaaccaacaacacctaattggggaaagcataaggaagagagctgtgttgcaatcaaaaggttttttttttacttgaatgtaaataccaatcaagatacattgaaataaggacctgaaggtggcaagacagtagaaagcaggagtaagagtggaaatgaaagcagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaatt

SEQ ID NO: 14052 - DNA, 2061 bp, Homo sapiens
gcagccacgggtcacgccagggccctgcacaccatgcagaggaaaggaagagctcagtgcgccagggtttcatacagccgctctctcaggccccaaggaaacgtctagagcgcacaggcggactcaccccagactgttcgaaccgtccctgagcgcccgccctcgtctcccggcaccactggccccgcagcagccagttgagaagggcggaggctgattccaatgaagtggcagaccgttaggcggcctctccaaaaagccagctatgtcgccgttagccaaggtttgagggtcttctccttctcttcgagggcccaacctcccctccagatttagtacaccagaggcgtcgcagcaacggctgctgcctgcgcgcctcagctaggcgggctcggatatttttaaggccacattggaaatcccgggcatgctcccgccggcggagaaggcccagacaaaatgtgcgccaatcaggatacagacttggaggacgtttaccctcaggaccaataagagggagggcggaccgggccaagggtgccggttcgctctccggatttaaacctcagcggtcggcggttaaccgcaggctcggcgcgtgggccggcagtgcgcctgcgcaagttacgcgaaagctaacagaatctgcggtgctctgctggcgactggcaggacgcggtgcagagagcggacttccgcgacgcgggttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattcatg

SEQ ID NO: 14053 - DNA, 1803 bp, Homo sapiens
ccggaagcggagggacgcggggacctggtggctgccggcccactgcggcgggagccctcgctccttttcccaccgtcgggacggtgcagagtggcagcttccctccgtggattccaggtcctgcctggcgagccgtccccaacgtctgcgttcctgagggaggcggccggggcagcgtgagctacaggcgatgtgcgcggcgggccgcagcccctggaggtcacggtgtgcgctggccgccgccgcggtctttgccccggtggcctttctgagctcctgggccgcgcccctgggaccaggcggaggccggggacggccccagggctggaggggagtcccgaaggccgctagcgacctgggtccaagccacgcccacggccaggcggggcgactgcgagctttgccgttgaaaggcggagcgtgtcttgtcgccttctagctgcaccttttgtggactgcagcatggaaccgtccaaggtgttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattaca

SEQ ID NO: 14054 - DNA, 1777 bp, Homo sapiens
ttaaaaaaaaaaaaacaacgaactccatctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatata

SEQ ID NO: 14055 - DNA, 1417 bp, Homo sapiens
gccaggctttgagtggctgcgtctaaacacttctttccctgaggactggaagacattagaataaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactgg

SEQ ID NO: 14056 - DNA, 1668 bp, Homo sapiens
ggtgtgtttcctaacacctccggcagtgagccaggctttgagtggctgcgtctaaacacttctttccctgaggactggaagacattagaataagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 14057 - DNA, 691 bp, Homo sapiens
ttctttagcctgaactgtgggtagtgatgtggtgtgtttcctaacacctccggcagtgagccaggctttgagtggctgcgtctaaacacttctttccctgaggactggaagacattagaataaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttc

SEQ ID NO: 14058 - DNA, 3037 bp, Homo sapiens
cggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctgttggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctgga

SEQ ID NO: 14059 - DNA, 1485 bp, Homo sapiens
ttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaagcatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcaggtaaacttatttcctttcaatgttttattatcagttaaaggaaaactaaagatccaatcctctgtataaagctgaaaaaggaaaaaaatatccaaagcctagtaaaaatttttttcttccagtgcttatcatctcttatgattaatctcagtgagcaagtggatgctaagaataccctaatggggccaggcgtggtggtttacccctgtaatcccaacattctgggaggccgaggtgggcagatcgtttgagctcaggagttcaagaccagcatgtgcaacatggcaaaaccccatctttacaaaaactacaaaagttagccaggcatggtggcatgcacccacagtcccagctacttgcagggctgaggcaggagaattgtttgagtccaggaggtcagggctgcagtgagctaagtaagatcgcaccactgcattccagcctgggtgacaaagtgagaccctgtctccaaaaaaaaagaaaaaaaagaaaaaaccctatggtctgcagatgtttgaacttacttttagtaataaggttgtctctacgaagggcaggaacagagttctaatcctttcaaaacaagtcacttgggtgttttttgttccgcacttgggcaggttttattgagac

SEQ ID NO: 14060 - DNA, 2044 bp, Homo sapiens
cctttctgggcaggacccgccccttggtcccgcagagccttggtacttggacctgaaccttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggagaa

SEQ ID NO: 14061 - DNA, 574 bp, Homo sapiens
ctcggacaaggtcggcagtgctagctgcagttaggacagtgacttggactagcgttccagctgaagttcgggacagtagtgtcacctgcgccctaatttatcatcacaagttaacgaagtctgggggtgtgggggtgtgtgtgtgtgtgtgggtgtgtgtgggcgtgtgtgggcgtcggccttaatgtaaccctggtctgcgtagaagtgtgtgttgtttcgcctgcttcccctgtacccaggtcggcggctatagagattgtggacggcgccatgggtttgcccgatttctgctgtaaagaataagactagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttac

SEQ ID NO: 14062 - DNA, 696 bp, Homo sapiens
acgtcagccaaggtgagacggcgagccctcagctctccgcccgggctttcccaaaggcgagattccacttccttccccgcaactgtcgccggtgcccccggccccctcccctccctgggaaagtgggagttgagggagcggaaggaaactcctcggacaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactc

SEQ ID NO: 14063 - DNA, 557 bp, Homo sapiens
aaagtaacacagctagtgactagaaccacgtgccctggctaccacttccgagtgacatcagctgccgatccataagaaataccttcaaaccaatgcagggattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttgg

SEQ ID NO: 14064 - DNA, 1519 bp, Homo sapiens
gaaccttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagtt

SEQ ID NO: 14065 - DNA, 1895 bp, Homo sapiens
agagggagtcctcgcggacgtcagccaagattccagaatgactatcttgacttacccctttaaaaatcttcccactgcatcaaaatgggccctcagattttccataagacctctgagctgttcctcccagctacgagctgccccagagagagaatctgaccaacacagttgatcacttgtaggtagatgacactggtttctggttggctcctatatggatggatcattgctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgtt

SEQ ID NO: 14066 - DNA, 1257 bp, Homo sapiens
gacgccggtgttttgcagtcctgggcagctcggcagtccagcccggcccgggtcatggtggtgggccgagggctgctcggccgccgcagcctcgccgcgctgggagccgcctgcgcccgccgaggcctcggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataa

SEQ ID NO: 14067 - DNA, 1481 bp, Homo sapiens
ctgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgctcccaggcccgtctcccggcccgtggcagtcggggctcgcggacaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataa

SEQ ID NO: 14068 - DNA, 1276 bp, Homo sapiens
gtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataacttccccttgcagactgttttcttctggcctttaggcctctgcttgtcccctcgggcctccttcctcctccgtgagccactgcagtccccccacccacgcttcaggtcaggcgtgagccggtgcctttgctgtggccttggctgggtgctgatgggactgtcaggcccactgctgcggtcggtacctttgcagcctgtgcttgtggtctgatctgctcaggcccccggcag

SEQ ID NO: 14069 - DNA, 1680 bp, Homo sapiens
aggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatctggcgtataagccactctacagctgggaggaagccaagcagaaaacggtggagtgggttggttcccttgtggaccggcacaaggagaccctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtg

SEQ ID NO: 14070 - DNA, 1676 bp, Homo sapiens
aggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatctggcgtataagccactctacagctgggaggaagccaagcagaaaacggtggagtgggttggttcccttgtggaccggcacaaggagaccctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaa

SEQ ID NO: 14071 - DNA, 1436 bp, Homo sapiens
gtttgcaaaaaaaatggggtggaggaaaatgaggcatctgtgtgagtatataaccatttgacatctctttttagccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatctggcgtataagccactctacagctgggaggaagccaagcagaaaacggtggagtgggttggttcccttgtggaccggcacaaggagaccctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatc

SEQ ID NO: 14072 - DNA, 352 bp, Homo sapiens
gccacaggaaatgaggtgagaaccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacac

SEQ ID NO: 14073 - DNA, 1741 bp, Homo sapiens
gttcaaggtaataagggctgagacacaagccacagagcataaagctccagtccttcctccagggatgaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaacatgga

SEQ ID NO: 14074 - DNA, 717 bp, Homo sapiens
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccatt

SEQ ID NO: 14075 - DNA, 1783 bp, Homo sapiens
aaggctaaagccaagactctttatcacactgtggccttaagattggatttctcttcctgttcctgggaagaattagagatataacctaaaggtcactattattctgagaaaagggattctggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaacatggag

SEQ ID NO: 14076 - DNA, 2215 bp, Homo sapiens
ggaggagccagcggaaggacggtgtgcgggccggccagccctggacgaaagaagagggcccctccaggccagtctgggcaccctgggatagcggctgcagcccgcccctctctccgtaactcagccatcagcaggggcagacggcaggtggcctggttgctgcagctcccaggatcagctctgccctccccgcaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 14077 - DNA, 2172 bp, Homo sapiens
gaaggacggtgtgcgggccggccagccctggacgaaagaagagggcccctccaggccagtctgggcaccctgggatagcggctgcagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggtccgtggggggctgcccctggtgacgtgtgcccttcgtcccacgggcatctacggtgaaggccaccagatcatgagggacttctaccgccagggcctgcgcctgggaggttggctcttccgggccatcccggcctctgtggagcatggccgggtctatgtgggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 14078 - DNA, 2022 bp, Homo sapiens
ggaggagccagcggaaggacggtgtgcgggccggccagccctggacgaaagaagagggcccctccaggccagtctgggcaccctgggatagcggctgcagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 14079 - DNA, 1501 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 14080 - DNA, 1411 bp, Homo sapiens
agtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgt

SEQ ID NO: 14081 - DNA, 1548 bp, Homo sapiens
ccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcgtcattccagagccctggactaggagtaggaagatctgaattgtggccccaactctctttcggttattagctctgtgaccctaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaa

SEQ ID NO: 14082 - DNA, 755 bp, Homo sapiens
gctcagtgtcctggttactgcagcggcagcaacagcaggtcctactatcgcctccctctagtctctgcttctctggatccctgaggagggcagaagccagtgattctggttcttggacaaggtgttgaggaacactagaaacagaggggactgtgacctggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcag

SEQ ID NO: 14083 - DNA, 1559 bp, Homo sapiens
gacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaa

SEQ ID NO: 14084 - DNA, 1155 bp, Homo sapiens
gaacaaacagatcctggtgggacagtgtacccaaggtcacccagccaagaggctgagcaggactgtacgtcagatccgtttacctcagtccttaatgcatgcagtccagccagattaagggacccttaatactgtcagctttccccactgtgggatcttcatcctcttgacttcttttgtagccagacatctgggcctcttgctggagaaggtggcagcttgctgctcttagactctagtctactccatgtggcatctggatggcactgaaattttctcaagtgccttgtctgttgtagataatgaatctatcctccagtgactcagcacaggttccccagtgtggtcctggctgccctgcccctgccagctgcaggccccacccttcctgtggccaggctgatgggccttatctctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcag

SEQ ID NO: 14085 - DNA, 1469 bp, Homo sapiens
gacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaagg

SEQ ID NO: 14086 - DNA, 1351 bp, Homo sapiens
agactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 14087 - DNA, 1415 bp, Homo sapiens
ggaggagggagagagagagaagagaagaaaaagaaaaaagaacatcaataaaaagaagtcagatttgttcgaaatcttgaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttctta

SEQ ID NO: 14088 - DNA, 1319 bp, Homo sapiens
acaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataa

SEQ ID NO: 14089 - DNA, 1391 bp, Homo sapiens
ccgcaaaggaagagagagatgaaacagaaggaaaggcagaggaggagggagagagagagaagagaagaaaaagaaaaaagaacatcaataaaaagaagtcagatttgttcgaaatcttgaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataa

SEQ ID NO: 14090 - DNA, 1879 bp, Homo sapiens
tcgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttctaaaa

SEQ ID NO: 14091 - DNA, 1220 bp, Homo sapiens
acagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatggctgtcgcctcagcctcccaagtagctgggataccggctaattttgtatgttcggtagagacggggtttctccatgttggtcaggctggtctcaaactctcgaccttaggtgatccgcccgcctcggcctctcagattgctgggcatacaggcatgagccaccgcgaccgg

SEQ ID NO: 14092 - DNA, 2223 bp, Homo sapiens
gggcctcccaaagtgctgggattacaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagccctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccagcacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggggctgcctttcaatgacgtttattgcgccagcaagttcgcgctcgaaggcttatgcgagagtctggcggttctgctgctgccctttggggtccacttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatggctgtcgcctgtaatgccagcgctttgggaggcggaggcaggaggatcgctcaagccccggagttggagaccagccagagcaacacagtgagacccccatctctacaaaaataaagaaaattt

SEQ ID NO: 14093 - DNA, 4982 bp, Homo sapiens
agttaggtgggacttgggttggggtagagtcaggttgtgacctgcactccattagccatgagacctcaggcaagttccttgctttctctgagtgctttcctttcctttcccttttcttttcttttttgtttttcttttgttttgagacggagtttcactcttgttgcccagcctggagtgcaatagcgcggtctcagttcaccacaacctctgcctcccgggttcaagtgtagctaggattgcaggcatgtgccaccacgcccagctaattttgtatttttagtagagacgaggtttctccatgttggtcagactggtcttggactcccgacctcaggtgatccgcccgccctggcctctcagagtgctgggattacaggcatgacccaccccatccggccctctgagtctttcttatctgtaaaatgggtataataatacctatctaatcggttttagtaatggtggagataatgcctgaaagtgctagtatagaggtttaatacccagcaaggactgttattagaatgaatagtaatatgactactgtcacattttgcaaatgtgtaaagaagaaagagggctaagtgaatcaaagggagacagccccactcaccctgttctgccccagaggactgagcgatccccaccatctgggaagctgcctcaccaggaggtccagctggggctacaggactggctactttgctacaatggcccatctttcctgagcccagtggagggtcccaggggggcagaagtcattgataggggccagtagggttgtagagccactgtctgaacttctgtggaggtctggtgcaggggaggtgtgaacagataggaggctaggtgaggatgcagcagaggaagggggcaggagtgccccaggagggggcggtaccgaggcagggattcagctgggtctgagagggagggaaggctgagggggatggccctttggagtgggcagggacatgaccacagaaagcctgggaagtggaaacagacaggagcctgctggagctcttggagctttgtgtggggcactaggggaaggaggcaggcactccaccctgacctgcccctacctctggatgagggtcttctctgcctgttggatgatgtgctgcccctgctcttggaggaagaggcctcccagccaccccctcctgccagtcgccttgccctgctgacccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccaccaaagaaaccccactgtctcccacagactccaggtctgtatctccaactgcctactcaatacaacacgtccacctgatacaatgaacttaatgtgtctaaaccccaattccacatttccagtcctcctaccggctcctcccccagtcttctctactttactatatgacaactccatttttcccaatactggttttaaaaaccctggagtagtccttgactccagtctctctcacctttcaaccaattcagcagcaaatactgacagctctacctttgctcatcaaagcatatccccaaatcaccctattccagactgcacactgtcatctctcccttcaattacagcagtagcctcctaactagttttcttgattccactcctgcccatcagcagtgaaattaccccagagcagttaaaatgatcttttaggatgggcacagtggctcacgcctgtaataccagcactttgggaggtggaggctggctgatccccttaggttgggagttcaagaccatcctcaccaacagggagaaaccccatctctactaaaaatacaaaaattagccggatgtggtgggacgtgtctgtaatcccaactacttgggaggctgagacaggagaactgcttgaacccgggaggtggaggttgcagtgagccagaatcgtgccacagcactccagcctgggcaagaagcgcgaaactccgtctcaaaataaaataatcttctaaaaatgacagggccaggtggggtggcacttttttataatccgagcactttgggaggctgaggtgggcagatcgcttgacatcaggggtttgagaccagcctggccaacatggtgaaactccgtctctactaaaaatactaaaaattagctgggcgtggtggcgggtgcctgtaatcccagctactcgggaggctgatgcaggagaatcgcctgaaccaggcagatgcaggatgcagtgagccaagattaagacactgcactccaacctaagcaatactttgtctcaaaaataaaaaaaagcctgggaaacaaagtgagaccccgtctctacaaaaaagtcaaaaaattagctgggtatggtggcagtgatggcacacacctgtagtcccggctacttgggaagctttttaatattttttgcagagaccgggtctcactctgttacctggcctggtcttgaactcctgggctccaacaatcccctttcctgggcctcccaaagtgctgggattacaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagccctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccagcacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggggctgcctttcaatgacgtttattgcgccagcaagttcgcgctcgaaggcttatgcgagagtctggcggttctgctgctgccctttggggtccacttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatggctgtcgcctgtaatgccagcgctttgggaggcggaggcaggaggatcgctcaagccccggagttggagaccagccagagcaacacagtgagacccccatctctacaaaaataaagaaaatttaaaaatc

SEQ ID NO: 14094 - DNA, 455 bp, Homo sapiens
acagtctcaccatggcctgcaccgtggtgctcatcaccggctgttcctcaggtattggcctgcacttggcaatacatctggctttggacccatcccagagcttcaaagtgtatgccacgttgagggacctgaaaacacagggccggctgtgggaggcggcccgggccctggcatgccctcagggatccctggagaggttgcagctggatgtaaggaactcaagctccctggccgctgcccgggaacgcgtgaccgagggccgtgtggatgtgctggtgtgtgacacaggcctgggcctgctggggccgctgggggaggacgctgtggcctctgtactggatgtgaatgtagtaggtactgtgcgggtgctgcaggacttcctgccagacatgaagcggccgggttcgggacgcgtgttggtgactgggagcatgggaggattgatgggtgagtgg

SEQ ID NO: 14095 - DNA, 960 bp, Homo sapiens
cccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagag

SEQ ID NO: 14096 - DNA, 823 bp, Homo sapiens
acaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctca

SEQ ID NO: 14097 - DNA, 916 bp, Homo sapiens
ccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagag

SEQ ID NO: 14098 - DNA, 1885 bp, Homo sapiens
tggtgtaaaagacaatcgcggccacacaccgcgtgggggctgcgcaaagcagaactaggaagctttgctccggtctggacttcgtccctcccagatctctgagctagcaagcactgcagcccgagccaattgcgaaagaccaacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacaaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaa

SEQ ID NO: 14099 - DNA, 2269 bp, Homo sapiens
gactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 14100 - DNA, 2397 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 14101 - DNA, 1232 bp, Homo sapiens
ggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcagcc

SEQ ID NO: 14102 - DNA, 1426 bp, Homo sapiens
ggaatatgattatgcttaatctatgctcagttgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 14103 - DNA, 783 bp, Homo sapiens
atgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggcgggctttctgagcctgatcccggcctgggccttctacagcggtgccttccaaaggctgctcctgacacactatgtggcatacctgaagctcaacaccaaggtcaggtag

SEQ ID NO: 14104 - DNA, 1135 bp, Homo sapiens
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccacttta

SEQ ID NO: 14105 - DNA, 2683 bp, Homo sapiens
gctcatcttcctaccagaaatcggcaagtcactgaccctcgtcccgcccccgccattccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttagaatttgtgatagcattgataagttgaaaggaaaattaaatcaataaaggcctttgatacctttg

SEQ ID NO: 14106 - DNA, 2740 bp, Homo sapiens
ttattcatgggctcaccgctgaggttcgacgggcgggtggtactggtcaccggcgcgggggcaggtgagcatgcgaaggttggaggccgcgccccttgctgaggcgcagctggctgctcttttcgggccggcatacgcgcgcagccgcagctgaggtcaccccgctgaggtggtggggaggggaatggttattcttgaggcaccgcatctcttgaggaggaaagagccggaaacacctggtctctcaagcaggattgggccgagcctatgccctggcttttgcagaaagaggagcgttagttgttgctttcaaaatctatgcaataaccctatggagaagatcatttcacaatgcagattctttgtttcaatgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttc

SEQ ID NO: 14107 - DNA, 2589 bp, Homo sapiens
tctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgctttcaaaatctatgcaataaccctatggagaagatcatttcacaatgcagattctttgtttcaatgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttag

SEQ ID NO: 14108 - DNA, 2225 bp, Homo sapiens
aatagtgcctgactgtcttttggaagaagagttagtgtctttgatttagaattaagctaagaagagcttttagtttctgcttcccttgtaacaactggggtaaaaaagaagctgagaaagataggatttgctggcaaagggggcctatgttggtgcttttcttggtgctgcaacgggactgagatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattattttta

SEQ ID NO: 14109 - DNA, 2494 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcagtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgccc

SEQ ID NO: 14110 - DNA, 1190 bp, Homo sapiens
ttccgaaagcagcggcggtgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataa

SEQ ID NO: 14111 - DNA, 666 bp, Homo sapiens
gagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagctgaaggcctgctgacccagggtgataagatcactgctgatggacttcaggaggtgtttgagaccaatgtctttggccattttatcctggtaaagaagctgtgggcttaataagctaatatttcgtgtgatagtttctgtaaagctctgggcacagggcattattatagttgagcagccagttaactgatttaatctcatgtttgagttttcttgattgcatttgccttgtttattgtgagcatggaatacttctggaagctttcctagtagatttttctttaataaatgtactaatagtttttgatttacagaattactgc

SEQ ID NO: 14112 - DNA, 507 bp, Homo sapiens
gaggcggcccgaaatcgtaggacttccgaaagcagcggcggtgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtatatctcttgctgatggattttttttctcatgtgattgtgcagcataacacttaataaaataagagaggaaagaaaaacctgaaaagaaacaggtgcggtgtaagcagttatgttgaggaagtctgtatagggtgacccattgtgtctcagtaccacgttttctttctttttttttttttttttaaag

SEQ ID NO: 14113 - DNA, 1386 bp, Homo sapiens
gaaatcgtaggacttccgaaagcagcggcggtgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagcttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatg

SEQ ID NO: 14114 - DNA, 357 bp, Homo sapiens
gttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagcttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaag

SEQ ID NO: 14115 - DNA, 990 bp, Homo sapiens
gggattcccacccacccacagcccgccatggcgtctcagctccagaaccgactccgctccgcactggccttggtcacaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatccgctgtaactctgtcctcccagggttcattgcaacacccatgacacagaaagtgccacagaaagtggtggacaagattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 14116 - DNA, 990 bp, Homo sapiens; identical to SEQ ID NO: 14115

SEQ ID NO: 14117 - DNA, 990 bp, Homo sapiens; identical to SEQ ID NO: 14115

SEQ ID NO: 14118 - DNA, 990 bp, Homo sapiens; identical to SEQ ID NO: 14115

SEQ ID NO: 14119 - DNA, 990 bp, Homo sapiens; identical to SEQ ID NO: 14115

SEQ ID NO: 14120 - DNA, 990 bp, Homo sapiens; identical to SEQ ID NO: 14115

SEQ ID NO: 14121 - DNA, 6798 bp, Homo sapiens
gtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggagccccccccgccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaa

SEQ ID NO: 14122 - DNA, 4734 bp, Homo sapiens
ttttaaaaggcagtggtagggtagagggtggcagtggagacagctggagagcactgaggacgcggacccacgggtactgtgtgagctgtgaagcccgcttgggagaccccactgccagccaggtgaccaggcattgatgcacccccaggaaggccacgcgctcaggagccccccccgccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaa

SEQ ID NO: 14123 - DNA, 6940 bp, Homo sapiens
ggccaagaattgtgtgtctgccaccagcgccccctggcctaggtggcccctgggtgtccttaatctcctgtgtgtgttagaggggcaggcattgcacccaccgaactccctagacctgttcgctggtccttactcttcctggctgtcagatccaactaccaggctctgtggccacagtctcctgctgggctgcccctggtgccccagccagagacccccaggtgcgtcccttcatcgcccttccctcccttcttcgctgatggctgtctgggtgactgtgttcgtcttctcttccccaggtgaccaggcattgatgcacccccaggaaggccacgcgctcaggagccccccccgccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaa

SEQ ID NO: 14124 - DNA, 3406 bp, Homo sapiens
ggccggcggcggcggcggcggctccgctccgcactgcccggcgccgcctcgccatggacgcgcgcgggggcggcgggcggcccggggagagcccgggcgcgacccccgcgccggggccgccgccgccgccgccgcccgcgcccccccaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtgaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcggggagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgcc

SEQ ID NO: 14125 - DNA, 3718 bp, Homo sapiens
tgggcgccatggaggcagagcagcggccggcggcgggggccagcgaaggggcgacccctggactggaggcggtgcctcccgttgctcccccgcctgcgaccgcggcctcaggtccgatccccaaatctgggcctgagcctaagaggaggcaccttgggacgctgctccagcctacggtcaacaagttctcccttcgggtgttcggcagccacaaagcagtggaaatcgagcaggagcgggtgaagtcagcgggggcctggatcatccacccctacagcgacttccggttttactgggacctgatcatgctgctgctgatggtggggaacctcatcgtcctgcctgtgggcatcaccttcttcaaggaggagaactccccgccttggatcgtcttcaacgtattgtctgatactttcttcctactggatctggtgctcaacttccgaacgggcatcgtggtggaggagggtgctgagatcctgctggcaccgcgggccatccgcacgcgctacctgcgcacctggttcctggttgacctcatctcttctatccctgtggattacatcttcctagtggtggagctggagccacggttggacgctgaggtctacaaaacggcacgggccctacgcatcgttcgcttcaccaagatcctaagcctgctgaggctgctccgcctctcccgcctcatccgctacatacaccagtgggaggagatctttcacatgacctatgacctggccagtgctgtggttcgcatcttcaacctcattgggatgatgctgctgctatgtcactgggatggctgtctgcagttcctggtgcccatgctgcaggacttccctcccgactgctgggtctccatcaaccacatggtgaaccactcgtggggccgccagtattcccatgccctgttcaaggccatgagccacatgctgtgcattggctatgggcagcaggcacctgtaggcatgcccgacgtctggctcaccatgctcagcatgatcgtaggtgccacatgctacgccatgttcatcggccatgccacggcactcatccagtccctggactcttcccggcgtcagtaccaggagaagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggagatcattaacttcacctgtcggggcctggtggcccacatgccgctgtttgcccatgccgaccccagcttcgtcactgcagttctcaccaagctgcgctttgaggtcttccagccgggggatctcgtggtgcgtgagggctccgtggggaggaagatgtacttcatccagcatgggctgctcagtgtgctggcccgcggcgcccgggacacacgcctcaccgatggatcctactttggggagatctgcctgctaactaggggccggcgcacagccagtgttcgggctgacacctactgccgcctttactcactcagcgtggaccatttcaatgctgtgcttgaggagttccccatgatgcgccgggcctttgagactgtggccatggatcggctgctccgcatcggcaagaagaattccatactgcagcggaagcgctccgagccaagtccaggcagcagtggtggcatcatggagcagcacttggtgcaacatgacagagacatggctcggggtgttcggggtcgggccccgagcacaggagctcagcttagtggaaagccagtactgtgggagccactggtacatgcgccccttcaggcagctgctgtgacctccaatgtggccattgccctgactcatcagcggggccctctgcccctctcccctgactctccagccaccctccttgctcgctctgcttggcgctcagcaggctctccagcttccccgctggtgcccgtccgagctggcccatgggcatccacctcccgcctgcccgccccacctgcccgaaccctgcacgccagcctatcccgggcagggcgctcccaggtctccctgctgggtccccctccaggaggaggtggacggcggctaggacctcggggccgcccactctcagcctcccaaccctctctgcctcagcgggcaacaggcgatggctctcctgggcgtaagggatcaggaagtgagcggctgcctccctcagggctcctggccaaacctccaaggacagcccagccccccaggccaccagtgcctgagccagccacaccccggggtctccagctttctgccaacatgtaaaacctttgagtacatccagccttagttcttggggtgcagtagtatgtacccaagggcagatgcctcttggggaaggccatggggacctgaaacattgccccatggaaatgtcgaccctgtgcggacattccgcatactgccatgaagacggtctctgtgtcctcagctcaagaatcctgtagcttgtcccatcataatccattcacccgttcatcatgtgtactgagcagctaccatgttcaaggtaatatgccaggcgctgtatgtctccactgccaagtagaagtgactcaaaaccctctgacaaggatattcccttggctatggtcctgccaggtgcaggcccaggcccatgaccccacctttactaagcacaagtacttgccactgccatcactgccaagtaactagatgtctctgtttccctgccaatgatcctgcaggttctgcccggtctggttatcttcctgttcctgtagcatagccaggcactgccagtcacctgtgcccccattgctgtcagcagatgtcttgggtcctgagtgtgggtatccacttttacccgctcactgccacctgtggacactctgtgtctaccctctgagtgggaacatacttctaagttccctgcagtctctgtcctgtggtagaccatctttttgtaaactgcgagcttcctcttccctgtaccctctgccccagtcgtgaccccctaaaagttaaggggtagttggcacctccttattaatatgccagcctagatcccccccggtggaggggcaaatggctgaatccttgtgtgatatttttttcttcgcttgtttatttattcatttatttaattgtatttattcatttactaactttatgtgttaccaattaattttgtttacccattcctttatccatccctcccctccttttcaggtaaggagacaggaggagtaggaggaggcagggcctctccatgccagcctctgtggtccttgcccaaacccatcagcgcaatacttgaaccttctcccaggtaggggcaggaggagccacatgagagagggagaaggaccgcgtttacctttagagttttgttttgttttttccttctgagtttgctgttggtgcaggaataagggaaaggcccaaggtatccaagcctggggaagggcaggccagccagcacctctgccttctcagggacaagagtagtcctttaccaccctcactctgcctgtcccctctcctactctacagcattaaagactgtgggaccaggaccctaagtctcctttccttctgggtggggagttctggggttcttggtgtgtgggagaagttttataattgcttccaaacagctgggtttaaatataaaatagacacactca

SEQ ID NO: 14126 - DNA, 7228 bp, Homo sapiens
caaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtgaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccatccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccacaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttcacaaagaccatggggtgggtactttgattctccccatttagcagaggaagaaacagttttgggtaatttttccagaatcatgtaactaggagtggcagagtggggactgatttgaggttcgagtccacgcctccttgaggcccaagtctgtgttccttccatcagaaaactgtgttgaggggggctgaggtagatggtccccaagcatggtacagaaggaagacaccagattttggcagcagtcaggcctgggtttgaatcccagccctgccacttcttagctgtatgatcttgggcaagttatctgacctttctgtcacctcatttgtaaaatgggaataattatggtactgcctcacaaggacctatgaggaccagatgagaaaaatctatatgtgaaatgcccagcccagcgcctggcacataccatggtaggtgctcaataaaaaatcacatttcttctgcccctcatatgcccagcctattgctccagcaaactatgtgagagcccagggagctttggctgagggctccaagacttaaaatctcaggactcaggaggtggctgggcctccctaagggcccaaggaaggtgtgtggccagaggtgggtgggagccaggccttgagaagtgggaagacttcaacagggagagagggagggaatggtgggtgggatggagtgtatggtggggagattcctgaggtggatgtggagtggtggatcagggctttgggaggggatccccaggctgaggggtcagagggacggccttgggtgatagggtaagggattgtctgggcttagtcctggcaactaggagccataagcaggttccagattgcgggaacgagaaagcagctcagatgcctttggaggcaccatcctccctcctcccagatgggatcttgccagagccaaggtcaggggtctgcccctgcctatagggccagagcaggtatggctgcaatccccaagtaatgagaagggctggtcccacattatccatccagaaccttccatgctccaagccagaatgttggcaagatcgggttttgccttgagctatcctgggatgtgagacaaaccgatttctccatagatgggctgcagggagtgggaggcagtactccaggagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagca

SEQ ID NO: 14127 - DNA, 577 bp, Homo sapiens
cacaattgacagcctcaaggttcctggctttttgaaccaccacagacatctcctttcccggctaccccaccctgagcgccagacaccatgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcgcaggcgcagagccagcgccgcgcccctgcctcgggcgccgctgttccgccccggccgccgcctccgtcgcgcccggaggacagtccgggatctgagtcgttcttcgggccctgtcctggcccaggcctctgccctctgcccacccagcgtcagcccccagaaaaaaggcaataaagacgagtctccatt

SEQ ID NO: 14128 - DNA, 3019 bp, Homo sapiens
atggtttccgttgggtgtgtggtttttttgtttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtga

SEQ ID NO: 14129 - DNA, 1462 bp, Homo sapiens
atggtttccgttgggtgtgtggtttttttgttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtc

SEQ ID NO: 14130 - DNA, 1044 bp, Homo sapiens
aaatgaaactcgacgctctggatagagccaaggaaggctcctgctattcgggggtcctcgagggagccattaaaacctcggcttcctcatttgaggaaacagcctgagccaaggagaaaattgaagtcctctcagctgcagctgctcacccacccccctcccacctccctccacagagaaaagcacccactccattgactctgaggggtcacgagaaggttcgggaaaaagggtcacagtcaagccacccaacccagccggccttctcccatcactacttgggtgcgagcataccctctctgtctcaccccatgccatcatccgggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataaggg

SEQ ID NO: 14131 - DNA, 2250 bp, Homo sapiens
ctttcctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcatt

SEQ ID NO: 14132 - DNA, 1709 bp, Homo sapiens
actcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 14133 - DNA, 2101 bp, Homo sapiens
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 14134 - DNA, 2101 bp, Homo sapiens
cgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 14135 - DNA, 2551 bp, Homo sapiens
agataagtcagggaggggacagagcggccctaggcgcgccacagagaggagcgaggcgccagaggcaccatggactggcaagaccacaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatga

SEQ ID NO: 14136 - DNA, 5908 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatgatgaattgcctggggtctgtaagaatgtgggactctgatcttccccctcttcaggtgtcagtgcggagaggctctgggccagacctcacccccagtgacttccgattgaggccaaagaccccaagctgcccgccagctctgactgccccttgcgctctgggcttcctgccgcccccagctttgcctggacactgacttcattcatggtcctcctacttcaggggcagcctcccagttcctctgcttccaaactatgcaacctccaacctgctccagttccagactgtataacctctgacctgcactggttctagaccacacaacctccaatgtggtctgctttagatcaccttcttcttcttccttcttcctcttcctcttcctcctgctcctcttcctcttcttcttcttttttttttttgacagagtcttgctctgtcacccaggctggagtgcagtggcgcgatttcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctctttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctagttctcctagattctgaacctcatgacctgtaccactcactagttccagactacacaacttctagaaggtgccacctccagggtcctgattcaagatctggtgatctgctgtttctctggttctagaactgacttacaagtgccttctgattctagacctcattccgtaagttcccttggctctagacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctaaacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 14137 - DNA, 2519 bp, Homo sapiens
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatga

SEQ ID NO: 14138 - DNA, 2462 bp, Homo sapiens
ggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacacctgtatgtatcccatttccccaggtgcgaagccagctgccacatggcccccagctgacaccaggaccccccagctccccataccccaggatgcactgcctccccacctcaacaccagctccctgctccccaagccccaaggaactgtctccttccttgccccctcatacccagtccccagatatttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgtgtgtgggcctgatctgcatgtgtggacaggtgtgtgtgtgtgtgtgtgtgtgtgcgtatgagcatgcatgtgtatcatgcataagtgtatgtgagggagtgtgcacgtgtacacatatgaggaatgtgtgtcaccatgtaaatgccggtgtgtgtgtctgcatggacacaggtatgtgtatgggtgtgtagactgttaatttttttttttttttttttttttttttttgcgtgaacctctgcttaagtggattgttaattcaaattagaaaggggtctttatttggcctggcatggtggctcatgcctgtaatcctagcactttgggaggctgaggtgggcggattgcctgagctcaggagttcgaaaccagcctgggcaacatgacgaaatgctgtttctactaataataccaaaaattagccgggtgtggtgacacatgcctgtaatcccaactactcgggaggctgaggcacgagaatcattagaacccaggtggtggaggctgcagtgagccgagattgcgtcagtgcactctggcctcggcaacagagcgagactctgtctcaaacaaacaaacaaacaaacaaacaaaaggactctatattcaagttaaaataagaagtgtaacagaatcatggggtcttttttgctttttaaattttgatgtggctcacacctgtaaatcccaaagtgttgggattacaggcatgagccactgcacccggcccatgttgtggtttatatcagtagttcctttgtaaatagtgaacagtattccatggtatgaatagagcacaggttttttttttatccattcaccagttagaagacattgggctgtttccaagtttgggtgattacaaaaaaacagctactgtaaacattctcatacaagattttatgagatcacatgttttcatttctcttgggtaaacagctaggattggaatggatgggttatatagtaagtgtatatttaatctaagaaactgccatggctgggcacagtggctcacgcctgtaatcccagcactttgggaagccaaggaaggaggatgactagagcctctgaggtgaagaccagcctgggcaaagtggttaagactcaaccgcaaaaaaagaaaaacagaaaacctgaaaacaaacc

SEQ ID NO: 14139 - DNA, 2101 bp, Homo sapiens
cttttctctttcccgagtcaccaccagtgaatgctgcccatgccctcaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 14140 - DNA, 1708 bp, Homo sapiens
actcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 14141 - DNA, 804 bp, Homo sapiens
gagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcgctttgttcctgtgtcctctgctgctacttccctctgcctaccctctctctcacccagtaaagtggctggctatagtcccgatgacctgatcggctgttccgcctacgagtacatccacgcgctggactccgatgcgccccaggatgcactgcctccccacctcaacaccagctccctgctccccaagccccaaggaactgtctccttccttgccccctcatacccagtccccagatatttctctccccatttgcccccttggtggccctga

SEQ ID NO: 14142 - DNA, 1367 bp, Homo sapiens
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacacctgtatgtatcccatttccccaggtgcgaagccagctgccacatggcccccagctgacaccaggaccccccagctccccataccccaggatgcactgcctccccacctcaacaccagctccctgctccccaagccccaaggaactgtctccttccttgccccctcatacccagtccccagatatttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgtgtgtgggcctgatctgcatgtgtggacaggtgtgtgtgtgtgt

SEQ ID NO: 14143 - DNA, 4511 bp, Homo sapiens
aatgtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactgcaggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctac

SEQ ID NO: 14144 - DNA, 4530 bp, Homo sapiens
aacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctac

SEQ ID NO: 14145 - DNA, 3134 bp, Homo sapiens
aacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgat

SEQ ID NO: 14146 - DNA, 2170 bp, Homo sapiens
aatgtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaaccagtgtctgcagagcctcagttaccaggtttggtttctga

SEQ ID NO: 14147 - DNA, 1570 bp, Homo sapiens
gccgcgtccggggccggctggtgcgcgagacgccgccgagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacccctgtgatttggaggtgtggagaaggggaagggagggacagctcactgtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttct

SEQ ID NO: 14148 - DNA, 2464 bp, Homo sapiens
gtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccagatgctcttcctttgtccagctagattgccacagtccaagcaggccattgaccgtttccatacagcagtcacctgtatggaacccccatggggtcggcggtgccgagccaggcctgcctggaggctctgctcctgatcgttccctggggcgcctgtggtgtttcccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgta

SEQ ID NO: 14149 - DNA, 3355 bp, Homo sapiens
agtttgcaaaccgagaggagttgtgaagggcgcgggtggggggcgctgccggcctcgtgggtacgttcgtgccgcgtctgtcccagagctggggccgcaggagcggaggcaagagcttctctgtttagggatgtggcaaagccgaggacccatgctctttcacttgggcctttgtgtgggcgctgctgggatgattagagaatggtttgtacccatcaggagggagaagggaagtaggctgatctgccctgggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctg

SEQ ID NO: 14150 - DNA, 769 bp, Homo sapiens
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaa

SEQ ID NO: 14151 - DNA, 610 bp, Homo sapiens
gcactgctgctgtcccatcagctgctctgaagctccatggtgcccagaatcttcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgtaccc

SEQ ID NO: 14152 - DNA, 898 bp, Homo sapiens
tttgggtttggacgggtgcgtttgtttctcatagtgcaggtctggagccggactgagatggggagtagagggaccccttgaaacttcagggtggatgaatatgaagtttcatcaccagctgtgatgtttgatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggagtgtgctggctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgtaccc

SEQ ID NO: 14153 - DNA, 662 bp, Homo sapiens
attctcctagagcatctttggaagcatgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggaacaggaggcacgtcctgtacccataaaaaccccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatct

SEQ ID NO: 14154 - DNA, 573 bp, Homo sapiens
tcactgacccatttccactgctgctccctcgtccgctgctctgaagcctaacccatggtgcccagaatttctgctgccatcttcatttttgaacttttgggttcaaactcagaaggagtcacagatcttagactgtggctatgccagccagcgcccaggtgcggggagtggacctacaaccccttggagcagtgctgtgatgacggtgtcatcctagacttgaaccagacccggctctgcggctccagctgcaccttctggccctgcttccagcactgctgcctggagtctttgggctctcagaaccagacagttgtgaggttcaaggtcccaggcatgaagccagattgcaagtcctcccctatcaccaggatctgtgcccaggaataccacccaaaaagccctgtgtcaagatctgacctcatctagactgttctggggtagcagagtcacagatcactctagaatctaatacttggtaattatactgcattgattttgttgttgttgtgacagagtttcactctgtcccccaggctggagtgcaaataagcaacttcagcaaagtctcag

SEQ ID NO: 14155 - DNA, 1194 bp, Homo sapiens
cacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactact

SEQ ID NO: 14156 - DNA, 630 bp, Homo sapiens
cacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactact

SEQ ID NO: 14157 - DNA, 1857 bp, Homo sapiens
cgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggccatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgct

SEQ ID NO: 14158 - DNA, 1962 bp, Homo sapiens
gggaaaaacaggaagcggaaaggctgcgaacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgc

SEQ ID NO: 14159 - DNA, 6189 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 14160 - DNA, 5928 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtgggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 14161 - DNA, 5499 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtgggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 14162 - DNA, 5760 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 14163 - DNA, 5928 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 14164 - DNA, 3487 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattc

SEQ ID NO: 14165 - DNA, 1748 bp, Homo sapiens
agtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtgggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttcc

SEQ ID NO: 14166 - DNA, 3572 bp, Homo sapiens
gtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaa

SEQ ID NO: 14167 - DNA, 3485 bp, Homo sapiens
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtcattaaagaagaaactaatcacagtgaaatggcagaagacctgtgcaagataggatcagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattc

SEQ ID NO: 14168 - DNA, 5229 bp, Homo sapiens
cctcgcctccctctcccccaacactgtcccctctccccaacccctcacagcctgcgcgcgcgcggagacacctcagtctacatggggaggacagagaagcgcaaagaacaagagaaaagatgcatccatctgagatctaaaaggagacaatgagaatctctttaaaatggacatagaagactgcaatggccgctcctatgtgtctgtaggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacc

SEQ ID NO: 14169 - DNA, 3683 bp, Homo sapiens
cttgcctctctcaggcatttgttgtgcagttcctctttgtctgctgggcacgaggggcaacagcatctgcctttccctccctgtgcacacacccaccacccacccccttcactgtcttggaaaagggatgctgtagcctagcatctcccccactatatacacatatacattctctccagccccctccccaagcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatgtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgttt

SEQ ID NO: 14170 - DNA, 2539 bp, Homo sapiens
ctctttgtctgctgggcacgaggggcaacagcatctgcctttccctccctgtgcacacacccaccacccacccccttcactgtcttggaaaagggatgctgtagcctagcatctcccccactatatacacatatacattctctccagccccctccccaagcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctctt

SEQ ID NO: 14171 - DNA, 420 bp, Homo sapiens
tggccattcctaggatgacctgggaatttatcccctctgcactgctccccaagcacttggataatgaagctgagctgtcttcaactgtattatatgtagacagaaggtcaccatctacagcctggtgaaaaatgagtcagacctttccactgtaaagacaaacacatgagctgagctaagaatctctttaaaatggacatagaagactgcaatggccgctcctatgtgtctggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgt

SEQ ID NO: 14172 - DNA, 4528 bp, Homo sapiens
gttgatagaaagataacgttgaaggcaagttgcccttgagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcctcgg

SEQ ID NO: 14173 - DNA, 2304 bp, Homo sapiens
tgcgcatcgggccggactacggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 14174 - DNA, 725 bp, Homo sapiens
attctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccaccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatga

SEQ ID NO: 14175 - DNA, 1090 bp, Homo sapiens
gtgtggtgctgtcgtcgccaccttgacttgtggtggctagtttgggtgggagtggtggtgatgtaaaggactggggctagccccgcgaggggcgtgaccttgtcacggagaggcatggcttcaccccgagcctaggcgcacaaagggcgtggtctggcagggttgggggcgtggccgcacagaaactggcggcaagggtcgtggccctggatcctgctgcgagaaggggcgcgatttcttccggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccc

SEQ ID NO: 14176 - DNA, 788 bp, Homo sapiens
gaaggtgaatagcgtcgggggtcgagctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctg

SEQ ID NO: 14177 - DNA, 878 bp, Homo sapiens
gcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactc

SEQ ID NO: 14178 - DNA, 1244 bp, Homo sapiens
gaccctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 14179 - DNA, 1350 bp, Homo sapiens
cacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 14180 - DNA, 1308 bp, Homo sapiens
atgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctcccctcgagtggtgagtatcgccgaagtgggcattcgcggggtgcgctgccctggagtcactggggaacgacccgactccagggcctcgacctgacctgtctcctgttttgtctccccttagtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttac

SEQ ID NO: 14181 - DNA, 1244 bp, Homo sapiens
gaccctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccctctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 14182 - DNA, 1350 bp, Homo sapiens
cacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccctctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 14183 - DNA, 1350 bp, Homo sapiens
cacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 14184 - DNA, 1244 bp, Homo sapiens
gaccctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 14185 - DNA, 1350 bp, Homo sapiens; identical to SEQ ID NO: 14183

SEQ ID NO: 14186 - DNA, 1244 bp, Homo sapiens; identical to SEQ ID NO: 14184

SEQ ID NO: 14187 - DNA, 1350 bp, Homo sapiens; identical to SEQ ID NO: 14183

SEQ ID NO: 14188 - DNA, 1244 bp, Homo sapiens; identical to SEQ ID NO: 14184

SEQ ID NO: 14189 - DNA, 1350 bp, Homo sapiens; identical to SEQ ID NO: 14183

SEQ ID NO: 14190 - DNA, 1244 bp, Homo sapiens; identical to SEQ ID NO: 14184

SEQ ID NO: 14191 - DNA, 1481 bp, Homo sapiens
atcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaa

SEQ ID NO: 14192 - DNA, 2340 bp, Homo sapiens
gcggccgcaagccgtcgccccctttaagagcctgctccgcgggactaacgttcgaacgggccctggcgcccctcctcgggctccgattggccgtgcgcggcgcacgagggcgcgccggccagccccggaacggttggcggcccttcgtgattggcggtcgagaagcctatataaggcgcggggcagccaggctgccctgtttagcgaccggacccgaaacggggaagttgtcttgtttggagaggttagtagagcagcgcgcgcgtcaccagagtcgtttctcttcggagtcttaggtgatcgagggtgtgcccagggggcggacttgtttgcgcctcccgttccctcccaatttccaaacgtgtcaccccggcgccgacggccctgtgcaggggaagcagatggagttcaagctggaggctcatcgcatcgtcagcatctctctgggcaagatctacaactcgcgggtccagcgcggcggcatcaagctgcataagaacctcctggtctcgctggtgctgcgcagcgcccgccaagtctacctgagcgacccgtgccccggcctctacctggccggtcccgctgggaccccggcgccgccaccgcagcagcagcccggggagccggcggccgggccacccgccggctggggagagccgcccccgcccgccgctcgtgcctcttggccggagaccgagccgcagccggagcgctcctccgtctcagacgcgccgcgggtaggggacgaggtgccggtggccacggtgactggagtcggggacgtttttcagggcggagaggcggacgcgacggaagctgcctggagccgcgtggaggggccgcgccaggcggcggccagagaagccgagggtaccgccggaggctggggcgtcttccccgaggtatctcgtgccgcgcgccgcccctgcggctgccccctaggcggggaggacccgccgggtacaccggccgcgaccccccgcgctgcctgctgctgcgcgccgcaaccagcggaggacgagccccccgcgccgcccgcggtgtgccccaggaagcgctgcgcggcgggggtgggcggcggcccagcgggctgcccggcgcccggctcgaccccgctcaagaagccccgccggaacttagagcagccgccgagtggaggagaggacgacgacgcggaggagatggagaccgggaacgtggctaacctcatcagcatcttcggttccagtttctcgggactcctacggaaaagccccgggggcggcagagaggaagaggagggagaggagagcggtccggaagccgccgagcccgggcagatctgctgcgataagccggtgctgagagacatgaacccctggagcacagccatcgtggccttctgagcccttggcccccctgcggggaggaggtggagcagcgggcgtccccgaagtgagggccaggcccttcccggctgcgaggacgcccagagaccgcgggcgctgagcgcgttgggcagactggttgcctctgggcatcgcaaactgcccccgggcgcatctggcttatctggagacctgggagcttgaggctcattggaagaggacgatcgttaacttttgtgtttgtgtatgtctgtgtatgtaagtttgtcttgtggcattaagactattttgctcttctggaatgcaccactccttccccagggtttaagagattgggggcagacagggactttcctctgccggctgcgtggagaaggaagcggctaaaaggtttgggccggggagttccccattcgttctccggggagggagggactttacacctacccctcaccggaaagctagacccgcttcagggccaggagtggcgtttccgcacaggatttcctaagacgagagggatttagccaagagcacagacttggattccttctgtccctccccacctttctctcccaatgaagaaacgtttatatcctgtgattactctaggaaaggggcgtattaacggtcctttgcttccccgcaggggagaaaaagcttgacgaacttcacagaagagttcaagcttggaaataatggagtttatagagaaaagatatatttttaaaagctctaggtcagaagtactacacagtgcttttaaaaagtgtttaatgagagtttacagacagaagcccgaagtggaaagaccttatggttttgtagatatggtgactccagtctttgttgtataaaggttgggggagctgataaggtttttgtacagtattttctccttcgttgtattgatttttgtataaaaatgtaacttctacgtgtctaacacgtattaaatattttgaagcaacgt

SEQ ID NO: 14193 - DNA, 966 bp, Homo sapiens
gtttagcgaccggacccgaaacggggaagttgtcttgtttggagaggttagtagagcagcgcgcgcgtcaccagagtcgtttctcttcggagtcttaggtgatcgagggtgtgcccagggggcggacttgtttgcgcctcccgttccctcccaatttccaaacgtgtcaccccggcgccgacggccctgtgcaggggaagcagatggagttcaagctggaggctcatcgcatcgtcagcatctctctgggcaagatctacaactcgcgggtccagcgcggcggcatcaagctgcataagaacctcctggtctcgctggtgctgcgcagcgcccgccaagtctacctgagcgacccgtgccccggcctctacctggccggtcccgctgggaccccggcgccgccaccgcagcagcagcccggggagccggcggccgggccacccgccggctggggagagccgcccccgcccgccgctcgtgcctcttggccggagaccgagccgcagccggagcgctcctccgtctcagacgcgccgcgggtaggggacgaggtgccggtggccacggtgactggagtcggggacgtttttcagggcagatctgctgcgataagccggtgctgagagacatgaacccctggagcacagccatcgtggccttctgagcccttggcccccctgcggggaggaggtggagcagcgggcgtccccgaagtgagggccaggcccttcccggctgcgaggacgcccagagaccgcgggcgctgagcgcgttgggcagactggttgcctctgggcatcgcaaactgcccccgggcgcatctggcttatctggagacctgggagcttgaggctcattggaagaggacgatcgttaacttttgtgtttgtgtatgtctgtgtatgtaagtttgtcttgtggcattaagactattttgctcttctggaatgcaccactccttcccca

SEQ ID NO: 14194 - DNA, 1659 bp, Homo sapiens
taacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgagcttactccagtgcccacagatacgacagagtgtcccaagtgcccctcacactctattagctgcatccttaacctctttttgccacaccataagcattgggttttgtttgttttgagatggagtcttgctctgttgccaggctggagtgcaatggcgtgatctcagctcactgcaatatctgcgtccagggttcaagcgattcccctgcctcagcctcctgtattagctgggactacaggcgcacaccaccacgcgcagctaatttttttgtattttagtagagaaggtttcacgatgttggccaggatggtctcaatctcctgacctcgtgatctgctcgcctcggccttccaaagtgctgggattacaggcatgagccacggcgcctggccagcattggggtattttattgaagatggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaa

SEQ ID NO: 14195 - DNA, 1862 bp, Homo sapiens
acttcgcgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaa

SEQ ID NO: 14196 - DNA, 1666 bp, Homo sapiens
cgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaa

SEQ ID NO: 14197 - DNA, 1438 bp, Homo sapiens
agcatttaaacttcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttgggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggactgaaaatcaggaggtgtaataaaatgttcctcgcattcccccccgcttttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 14198 - DNA, 275 bp, Homo sapiens
gacttggaagtaaaatatagagcttctactgaaatatttgtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggaga

SEQ ID NO: 14199 - DNA, 640 bp, Homo sapiens
gggaccttaaaggactttcatttctctccccttccttcatctctcctccttcacttaccttcatttattattctaggcatgacaagtgtcagatgtctgatttgaagactaatatgaatatatctagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtca

SEQ ID NO: 14200 - DNA, 528 bp, Homo sapiens
atgaagaaccatttgcttttctggggagtcctggcggtttttattaaggctgttcatgtgaaaggttcaagagattcttctgcctcagcctcccgagtagctgggattacagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaa

SEQ ID NO: 14201 - DNA, 901 bp, Homo sapiens
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggttcctgctccagcgcggctcctggactggccccaggtgctggccccgggggtttcaatccaagcataactcagtgacgcatgtgtttggcagcgggacccagctcaccgttttaagtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 14202 - DNA, 716 bp, Homo sapiens
gagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 14203 - DNA, 3961 bp, Homo sapiens
gcgaaccgcgtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgagggacctcccaggtgtggctgccacagaagagacgggtgtgcccctgctcttggtggacaccgccggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacac

SEQ ID NO: 14204 - DNA, 2371 bp, Homo sapiens
aaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccc

SEQ ID NO: 14205 - DNA, 2175 bp, Homo sapiens
gcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccc

SEQ ID NO: 14206 - DNA, 570 bp, Homo sapiens
acaatccctagcttggagccgtccagggggcatctgcttcttccacaacccacaactgaggccccagaaatcccagctgcgtttgggctgagcctctggcctcacccaagtcagctgagaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgct

SEQ ID NO: 14207 - DNA, 585 bp, Homo sapiens
gcacaaggggcctcgtctgggccaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactg

SEQ ID NO: 14208 - DNA, 4817 bp, Homo sapiens
ctcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 14209 - DNA, 2306 bp, Homo sapiens
cttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttcc

SEQ ID NO: 14210 - DNA, 2933 bp, Homo sapiens
agatcccacatctcaagtcgtgcagtgcaggtcctcctattgcttctctgctgggtttcggtcacagtggagggctgtatgcacacacaggcacatgcctgtgttcttgagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtgggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttg

SEQ ID NO: 14211 - DNA, 4259 bp, Homo sapiens
atatcagcccagatccaggcaaaaatgggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttg

SEQ ID NO: 14212 - DNA, 3350 bp, Homo sapiens
attaagatgctcaacactcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccggagcccgtgcccttttctaaacgcgtctgtatgcagtcaataaaacaatcgatttg

SEQ ID NO: 14213 - DNA, 4384 bp, Homo sapiens
agctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttg

SEQ ID NO: 14214 - DNA, 4378 bp, Homo sapiens
gccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaa

SEQ ID NO: 14215 - DNA, 1786 bp, Homo sapiens
gcctttctcctttccttcccggatcccagacctgcctcgatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaa

SEQ ID NO: 14216 - DNA, 1820 bp, Homo sapiens
atgccgggcagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaa

SEQ ID NO: 14217 - DNA, 4594 bp, Homo sapiens
aggtgccaggcagagttggtgtaggtgggctccccgagcccggcgcagggaggggaggaggttggggcgggccggcaggcgggcgggggagagaggaaggcggggctcagagccgaagaggctgtccttagacagctcttctcatgccgggcagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtgcaatttcttttgcaggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttc

SEQ ID NO: 14218 - DNA, 5180 bp, Homo sapiens
atacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcaacctcctgggttcaagtgatcctcctgcctctcagccttccgagtagctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattctgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttc

SEQ ID NO: 14219 - DNA, 4406 bp, Homo sapiens
cagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattctgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaa

SEQ ID NO: 14220 - DNA, 3842 bp, Homo sapiens
ttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctgggg

SEQ ID NO: 14221 - DNA, 7253 bp, Homo sapiens
gcgtcccctgaggcgtgcgcctggatggactgaaggacggtccgacgcgcgcggagggagagggccaggggcgagaaatctgctcgcgctggggtaccgcttcagggctgccgaacgccaacttgcttcgtgtgccctaggcaggcgtggggcaggtggcgcctccgtgacctaccaccatggatggaaacggactttttggtgaagaaacccaaacggttgatgccaggcagggtgatttggccgtcaaaggttttgacgaaacctgccctgttctctctggggaatccgaatgagggagatcacagacaccttcactgagaagccaaggacatttctgtataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaat

SEQ ID NO: 14222 - DNA, 7254 bp, Homo sapiens
ggggactcgggaggggccgcagcgcggctgctggtgccgttgcgggagaagaggaagcggcgcgtcccctgaggcgtgcgcctggatggactgaaggacggtccgacgcgcgcggagggagagggccaggggcgagaaatctgctcgcgctggggtaccgcttcagggctgccgaacgccaacttgcttcgtgtgccctaggcaggcgtggggcaggtggcgcctccgtgacctaccaccatggatggaaacggactttttggtgaagaaacccaaacggttgatgccaggcagggtgatttggccgtcaaaggttttgacgaaacctgccctgttctctctggggaatccgaatgagggagatcacagacaccttcactgagaagccaaggacatttctgtataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaat

SEQ ID NO: 14223 - DNA, 1034 bp, Homo sapiens
gaaaaaagaaagccaactttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcaaaatccaaccctctaagaaacaaagaaataaaagaagactcacaaaagaagaagagtgctcggcgtatttttcaggaaattgctcaagaactataccataagagacatgtggaaacaaatcagcaatctgagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaataaaggtaaactgaaaagacaactggctacaaagaaggatgtcagaatgtaaggaaactataactaatagtcattaccaaaatactaaaacccaacaaaatgcaactgaaaaataccttccaaatttgccaagaaaaaaaattctattttaaa

SEQ ID NO: 14224 - DNA, 2343 bp, Homo sapiens
gccggggcgagaatggtttcagaactgccgagggctggagggaaagcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 14225 - DNA, 2004 bp, Homo sapiens
attcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttat

SEQ ID NO: 14226 - DNA, 2366 bp, Homo sapiens
gccggggcgagaatggtttcagaactgccgagggctggagggaaagcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccagcccacaccgggcacccttttcaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 14227 - DNA, 1059 bp, Homo sapiens
ggaactggggctgggccgaggcccggggcggatccagggctggagtcttggcggggcggggcggggaggggcggggccggggcggggctgggactcgatgcgactcaaagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgt

SEQ ID NO: 14228 - DNA, 2663 bp, Homo sapiens
cggcgagagtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaag

SEQ ID NO: 14229 - DNA, 3996 bp, Homo sapiens
gtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctgcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatg

SEQ ID NO: 14230 - DNA, 4044 bp, Homo sapiens
gtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatg

SEQ ID NO: 14231 - DNA, 7309 bp, Homo sapiens
gctccgcccgggcgagtagtgcaggtgccgctgcgccggggccggggaggcgcgcgccgagccgagcggagcctaggagggatggagagctggccacccgggctgcaggagcaccggcgcggggcgtaggcggcgcgaggcgggcgcgaggcgggcgctcgggcgcgaggcgcgtgcgggcgcgggagcactttgcgataggatgaggctccgggctggcgcggtagtactatgatttggtatgtggccactttcatagcaagtgtgatcggcacccgagggcttgcggctgaaggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacgcccctcccacctttacagaaacacccccccagtacatcgaggccaaggagggtggtagtatcaccatgacctgcacagcttttgggaaccccaagcccattgtcacctggctcaaggaggggacgctcctcggtgctagtgggaaataccaggtgagtgacggcagcctgacagtgacatcggtcagtcgggaggacagaggtgcctacacctgccgagcgtacagcattcagggggaggctgtccacacgactcacctgcttgtccaagggccccctttcatcgtctcccctcctgagaacatcaccgtcaacatctcccaggatgctctgctcacctgccgggcagaggcgtatccgggcaacctcacctacacctggtactggcaggacgagaacgtctactttcagaacgacctgaagctgagggtgcgcatcctaatcgatgggaccctgatcatcttccgggtgaagccggaggactcggggaagtacacctgtgtgcccagcaacagcctggggcgctccccctccgcctcggcgtacctgaccgtgcagtacccagcgcgtgtcctcaacatgccccctgtgatttacgtgcccgtggggatccatggctacatccgctgccctgtggacgcagaaccaccggccaccgtggtcaagtggaacaaggacggccgtcccctgcaggttgagaagaacctcggttggaccctgatggaggatggctccattcgaattgaggaggccacagaggaggctcttggcacttatacctgtgtgccttacaacactctggggaccatgggccagtctgcccctgcgaggcttgtcctgaaggaccccccctatttcacggtgctaccaggctgggagtacaggcaggaggccggccgggagctacttatcccctgtgctgccgcaggggacccctttcctgtcatcacttggagaaaggtagggaagcccagcagaagcaagcacagtgccctgcccagtgggagcctgcagttccgtgccctgagtaaggaggaccacggggagtgggaatgtgtcgccaccaacgtggtcacgagcatcactgccagcacccacctcaccgtcatcggcaccagcccccatgccccgggcagtgtccgggtccaggtctccatgacaactgccaacgtgtcctgggaaccaggctatgatggaggctacgagcagacattctcagtttggatgaagcgggcacagtttgggccccatgactggctgtccttgccagtgccgccaggacccagctggctgctggtggacaccctggagcctgagacagcgtaccagttcagcgtcctggcccagaacaagctgggaaccagcgccttcagtgaggtggtcactgtgaacactttagcattccctattacaactccagaacccctggtgctggtcaccccaccgaggtgcctcatagccaatcggactcagcagggtgtgctcctgtcctggcttccgcctgccaaccacagctttcccatcgaccgctacatcatggagttccgtgtcgcagagcgctgggagttgctcgacgatggcatccccggcaccgaaggagagttctttgccaaggatctgtcacaggacacgtggtatgagttccgggttctggccgtcatgcaggatctgatcagcgagcccagcaacatcgccggcgtctccagcacagacatcttcccgcagccggacctgaccgaggatgggctggcgcggcctgtgctggcgggaatcgtagctaccatctgcttcttggcagctgccatcctgttcagcaccctggctgcctgctttgtcaacaagcagcgcaagcgtaagctcaagcgcaaaaaagaccctccactctccatcacccactgcaggaagagcctggagtctcccttgtcctctggcaaggtgagccccgagagcatccgcacgctccgagcgccgtcagaatcctccgacgaccagggccagcccgcggccaagaggatgctgagccccacccgtgagaaggagctgtcgctgtacaagaagaccaagcgggccatcagcagcaagaagtacagcgtggccaaggcagaggccgaggcagaggccaccacgcccatcgagctcatcagcagaggccctgacggccgcttcgtgatggaccctgccgagatggagccctcgctgaagagcaggcgcatcgagggcttccccttcgccgaggagacggacatgtaccccgagttccgccagtcggacgaggagaacgaggacccactggtgcccacatctgtggccgccctgaagtcccagctcacccctctgtcatccagccaggagtcctacctgccaccaccagcatacagccctcggttccagccccgcgggctggagggccccggtggcctggaaggtcggcttcaggccacaggccaggcccggccccctgccccccggcccttccaccatggccagtattatgggtacctcagcagcagcagccctggggaggtggagccgcccccgttctacgtgccagaagtgggcagccccctgagctccgtcatgtcgtccccgcccctgcccaccgaggggccctttggccaccccaccatccccgaggagaatggagagaatgcatccaacagcacgctgcccttgactcagacacctacaggagggcgctcccctgagccctggggccggccagaattccccttcggggggctggagaccccagcgatgatgttcccccaccagctgccaccctgtgatgtgcccgagagtctgcagcccaaggccggcctcccccgaggactgccccccacctccctgcaggtgcccgcggcctacccgggcatcctgtctctggaggcaccgaagggttgggcaggcaagtcgcccggcaggggccctgtcccagcgccccccgccgccaagtggcaggacagacctatgcaacctctggtaagccaagggcagctgcgacatacaagccaaggcatgggcatacctgtgctgccttaccccgagccggctgagccgggggcgcacggcggccccagcacatttggcctggacacccggtggtatgagccccagccccggccccggcctagccctcggcaggccaggcgcgccgagcccagtttacatcaagtggtgctacagccctcccggctctcacctctgacccaaagccccctcagctcccgcaccggctcccctgagctcgccgcccgtgcccggcctcgcccgggcctcctgcagcaggcagagatgtcagagatcaccctgcagccgccggctgcagtcagcttttctcgaaagtctacgccgtccacaggctccccctcccagagcagccgcagtgggagtcccagctaccggcccgccatgggcttcaccactctggccaccggctacccttcccctccacccggccccgcccctgctgggcctggggacagcttggacgtgtttggacagacgccttcccctcgaaggacgggggaggaattgctccgaccggagaccccaccacccacgttacctacttcagggaagctgcagagagacagaccagctcccgcgaccagcccgcctgagagagcactctctaaactgtagcagctggtattccagctatctgggcagtgttgtcgagacaagcctctcctcagctcaataggtaagggagctcctcggctgggcgggcgggggcgggcaggcggacggggcttcggccgggccattgcttcctggacaggggatccaaaccatgtcccctcaccgccccgtggggtggccgctgccgctcctcgatccccacggcttctgggttccccacatcgagccacgctcggcaccgcctagctgcagcttctgccccccaccccccgtccccatgtccggcccctctagagccccctgcggctctcctcactcctcgccagcctcgccagcctgctgccagtacacccagggcctcccacagaagccctggggccctgcatgcaccccgaaggggcccagaacacccgagatctgctttgcatctctgcacccttggggacctctctggggcccctctggtatccaggaagagcccccccgcaccctattctcccagcagccccaggcatagcatcccttctcctggggtggctggcccctcaccagcttcttgagatcttcgtggtattaggctctctcgaggagtacaaggttgggatgagccccacttcttccttgacagtggggtcctctgcagggtcaggtccctgcagtcctatggggctttgtagcgaaatgtcatcactcccctgtgctccttgccttctgcagcctgaccttggtagtcacaggactgaaatgtgacctagcccttgggtccacattgctttcaaggtccctgttgtagccttgtcgtcctccctgggtcatgctgtagggaaagggtcttaggaggacctccccgaggggagggggcaggcttcccctgggcagacaggcattgagctggcaggaagtgaaacccccagggaccagcactgtgtccctccccctgcccccgcagtcagcctctccttgagtgtccttccaggtggaagctaaaggaacttgggcattcagggagcctctgagtccctcacagagactcagggccacccgaagctcgctccctctcacagtagcctgacaaggtgctgccgctcgccacggaccctctgccctgtgcctgggcacacacaggcatcgggcacctgcatgggagacggcgagcctcccgtccaggtgcttctggctttccaggcgagaaggagacaggtgccttccccccctagagatgtcaagggaggttcactttcctaaccagggctataaatctcattcattcctaagagtggcctccataaagaggactgccctgacatttctttaccatctgtagctataaaattgtcagcagcccagaggccctggaattgtgggtgaggctgtctggcatagggtgagtgtgagggctgtcaggcagcgtttatgagctcacctgctctggggccctcctgcgcccagagacccactggtcttccaccttccccagctccctccctgtcccagctgtgactcctccacagcccccggaggtgtgggagccctagactagctctcaccccagctcctggaaattcctagactctgctctcatgtgttattcctcaccccttcactcaactccattgaccctctcctttcccagtgtccccactgtgccagatccaagagaagcccgctctcctttcactgctgtggcaaacccagaaaccaggggcagcgatgagggaccatcgtttctctcccgggcctggccagcatccccagcctaggagaaggagaccctccccatcctgagtcagcccctcggtgctggcctctcctgcctgctgggagcctccccggtacggctgctgggtcctggggagatgcaggctctgttcagatgctgtctccatgctgcacctttgcatgtgtgccctcttggtcttgcttggagaagttgtgacagctcttgtccacgtgcgttctcactgtttcttttcccttcagttcctctcctgttcctttggtccatatgtagttgttgcccctgcctctcctcctttctctctccctttttttctcctcttcccaactcccttctcaacatggggagttgtattgcgtggacctgtcctttctgtggactgtggggaggccgagccaattcttagctcctgtctgagcctagtgatgccctgtcctcacctctgcttccactccctttcccattcaggctgactgtcaccgcagggaggcaggtgggtctggagcatggagtggcccctgtcctgggtcagctgtaggaaggggcccctttgtaaacaagcttctgccaggttctgaggcagagcactggtctgagtccggccccacagaagggttccatcttgtggtcagcggggtgggctcagacctgcagactcccgcagtgggcccaccctttcccttgctatggcccgtctatgagtggctttcccctgcctccatcggtgtataatcaggcaggtggtgtttgctcttaggtgattagaagaggaggaaaatgcccatcaagccactgcttcagcctgttggccagggaacacctgaacagggtcaaaatggtcagctcctgggcgctgagctaaggaaatatgcagggggttttgactttccctgtcctgaggcttgcctccactttgacctggctgcatctttcctcagctcttctgggtaagctgagagctaagcaaataagacctcctgggctacctggtcatgatttgggttttgtatggattttttgaaaagagagaaaaagagtgtgggctgggtgccgtggcccagagggcagatctcttgagtccaggagttcaaggccagcctgggcaacatagtgaagccccatctctgcaaaaaaatacaaaaaaatagctgggcatggtggcacatgcctatagtcccagctccttggggggctgaggtgggaagatcatctgagctggggaggtcgaggcagcagtgagccgagattgcgccacttcactccagcctgggtgacagagaccctgtctca

SEQ ID NO: 14232 - DNA, 2659 bp, Homo sapiens
ccgaggggttccttggagaaggtggtgcgtcctggggcggcagctgaggaagaaagacgcagtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcgtgataaatgaagtgatgtggtgggaccatggagtgtattactgcaccattgaggctccaggggacacatcaggagaccccgataaggaagtaaagctcatcgtcctacactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcggctcctgtgtgtcatcagcatcacctaggtttccagctgacttgggaactgcaagtctgagtctaacagtttttggcttagattctgagaatcaaatagaagaattttaaatacaagagtttgagattgggtatagtggctcacacctgtaatcacagcactttgggaggctaagaatcacttgagactaggagttcaagatcagcctgggaaacatagtgagaccccgtctctacaaaaaatataaaaattagttaggtgtggtggcatgcacttgtagtcccagctactcaagaggctgaggcagaaggatcccttgagcccaggagtgcaaggctgcaatgagccaggatcccatgatcacacatctgtattccagcctgggcaatagagcaagtccccattactaaaaaacccaaaaggccaaaaaacaaaaaagttagagttcgaggaattaccaactgtagttttagccttggttcatgctctcttgcatatttatataatctctgacttgtaatggaccctgactggaatgtgatccctcaggaacttagtagcctgagtctttcagtagactacactgcccagaaccctggccattctcaaaatgagaacttgggaatgtttaagaagaaatcaaacatgtttcaggaaaaggaaatctatggagtattatagggacattcccatgggaatgtatcttcctccatggcatgtcttgagggtcctttcttgttaggagtttatcctgccagcccataaatggactatttattgtaagtgtagaaaatcacagagaagcagttttgcaccagccttattcctgtgccttgttttcctcttgctctttttttacctgtatatctaatttatattttcatatatattgtgtattgattgaagtcactttaaatccttcttgggaatgacacagtatataaataaggaagaaagaaaacatgccaagctgagcatgctgctccaaataaatatctgctttccta

SEQ ID NO: 14233 - DNA, 2226 bp, Homo sapiens
ctgcgccgagggaggggaaacccgaggggttccttggagaaggtggtgcgtcctggggcggcagctgaggaagaaagacgcagtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcgtgataaatgaagtgatgtggtgggaccatggagtgtattactgcaccattgaggctccaggggacacatcaggagaccccgataaggaagtaaagctcatcgtcctacactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaagccctggcccgccaccgctacatgaagcaggcccaggccctaggtcctcagatgatgggaaaacccctgtactggggggcggacaggagctcccaggtttcatcttatccaatgcacccgctgctgcagcgagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcggctcctgtgtgtcatcagcatcacctaggtttccagctgacttgggaactgcaagtctgagtctaacagtttttggcttagattctgagaatcaaatagaagaattttaaatacaagagtttgagattgggtatagtggctcacacctgtaatcacagcactttgggaggctaagaatcacttgagactaggagttcaagatcagcctgggaaacatagtgagaccccgtctctacaaaaaatataaaaattagttaggtgtggtggcatgcacttgtagtcccagctactcaagaggctgaggcagaaggatcccttgagcccaggagtgcaaggctgcaatgagccaggatcccatgatcacacatctgtattccagcctgggcaatagagcaagtccccattactaaaaaacccaaaa

SEQ ID NO: 14234 - DNA, 684 bp, Homo sapiens
gtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgctgctgctgtcctgaggaagccctggcccgccaccgctacatgaagcaggcccaggccctaggtcctcagatgatgggaaaacccctgtactggggggcggacaggagctcccaggtttcatcttatccaatgcacccgctgctgcagcgagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgagaatcaaatagaagaattttaa

SEQ ID NO: 14235 - DNA, 1456 bp, Homo sapiens
gtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccccctggcccgccaccgctacatgaagcaggcccaggccctaggtcctcagatgatgggaaaacccctgtactggggggcggacaggagctcccaggtttcatcttatccaatgcacccgctgctgcagcgagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcg

SEQ ID NO: 14236 - DNA, 1612 bp, Homo sapiens
taagaacccagactctgtctgtgagctcctagccaggtcaggcaggatggcaggcaatatcttttgcccatttgcattgtttttcttacccatgagcagagtaggtcaccttcagcattttctcctgctcttggctttagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcgtgataaatgaagtgatgtggtgggaccatggagtgtattactgcaccattgaggctccaggggacacatcaggagaccccgataaggaagtaaagctcatcgtcctacactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaactt

SEQ ID NO: 14237 - DNA, 2881 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccagggcggagcccagtcgactcccggattcccctgccccgcccccggcacgaggccccgccccggcggccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccacta

SEQ ID NO: 14238 - DNA, 2395 bp, Homo sapiens
ggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatc

SEQ ID NO: 14239 - DNA, 2479 bp, Homo sapiens
actcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatc

SEQ ID NO: 14240 - DNA, 2580 bp, Homo sapiens
actcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagctgtttcctcctagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccact

SEQ ID NO: 14241 - DNA, 2324 bp, Homo sapiens
tccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctcc

SEQ ID NO: 14242 - DNA, 2431 bp, Homo sapiens
atggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagcgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccacta

SEQ ID NO: 14243 - DNA, 1765 bp, Homo sapiens
agtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctg

SEQ ID NO: 14244 - DNA, 2283 bp, Homo sapiens
gtcagcagtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccact

SEQ ID NO: 14245 - DNA, 1643 bp, Homo sapiens
cgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaa

SEQ ID NO: 14246 - DNA, 1111 bp, Homo sapiens
cgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtatgcacacaaaaacagcaccctcatttccag

SEQ ID NO: 14247 - DNA, 795 bp, Homo sapiens
gaaaagtgcgccctacgaaaggacggtcgacttcggcggggcccaggtgagaaaggcccacctgtgtcctggttgagggtctccagggttctttggggcccgaggaatttcagacctgaacaatcaggtggacaacttcttgtgactttgggtattctgaaattactgccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattc

SEQ ID NO: 14248 - DNA, 475 bp, Homo sapiens
aggacggtcgacttcggcggggcccaggtgagaaaggcccacctgtgtcctggttgagggtctccagggttctttggggcccgagcatcttgactctactgtgcctggatgtagctgtgtgttttgccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttat

SEQ ID NO: 14249 - DNA, 552 bp, Homo sapiens
gcgtattgctgaaaagtgcgccctacgaaaggacggtcgacttcggcggggcccaggtgagaaaggcccacctgtgtcctggttgagggtctccagggttctttggggcccgaggaatttcagacctgaacaatcaggtggacaacttcttgtgactttgggtattctgaaattactcatcttgactctactgtgcctggatgtagctgtgtgttttgtgtgtatcctgttcatggccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccact

SEQ ID NO: 14250 - DNA, 685 bp, Homo sapiens
gagaaaggcccacctgtgtcctggttgagggtctccagggttctttggggcccgaggccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 14251 - DNA, 1205 bp, Homo sapiens
cggcggagggcggggtctgcgcggggacttcccccgggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttg

SEQ ID NO: 14252 - DNA, 1519 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttg

SEQ ID NO: 14253 - DNA, 528 bp, Homo sapiens
atggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatga

SEQ ID NO: 14254 - DNA, 333 bp, Homo sapiens
atggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagagatgggagaaaactgaaaaggatatga

SEQ ID NO: 14255 - DNA, 421 bp, Homo sapiens
ggtctgcgcggggacttcccccgggctgagctgcgcagcggggttttggccaaattgggcgagggcacaaaataaccacttaccccttctcaccgaggaagagcgggagaaaggtggcctgattcttttgagaagccttcctactccttactcccaaccctgatcaaaggaaaagccatgttgtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattg

SEQ ID NO: 14256 - DNA, 833 bp, Homo sapiens
cccccgggctgagctgcgcagcgggtgcggagggcgggcgcccgggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggca

SEQ ID NO: 14257 - DNA, 2028 bp, Homo sapiens
aaaatagaagagactcactctgaaaccaccattccagaaacccgggcagggctcggctgtccctctggctcccagattcttttggcggctctcgctttgggaggctctcacattcctctgcagatctgccccttcctccttcctcctcttgctcctgggccactgggttttcaaaaatccggaaaatccaagaggggcaaggagaaaagcagcagccgcctgaatcgagtccaagggtggatgtgtccggcttcacaacgagccaggccgggaaaacaaggactgaggcttacacaacaggccgccaactcttcgaccccggctgcgcagccggagcccccgccggctcgggcgccctctccccgccccagaagtggccagccccaaccccggaggaaggagggggcgcgacgaggctgtcgggcgacttctagccactcgctgagtggtctcttttgtttgcctaattcctcagcagtttctgagcctgacgctgaccctgctctgaatcccaggaaccccgtccaaaggtaaccccagcagaaaccggttcctcacccgggacttacgacccccgatcaccaccctcgcgtgcacgcacacactcaacagtttggagtttggagagtgagctccggcgagcagatggcgcggccagccgtctgtccgtccgtcctcctctccgccctgcggggcccggccagtggggggcgggctgcgcccccagcctgccttccccggcgctcgcagaccctccgctccgccagcgagaaggcagctccaaaacaaaaaggcgattccgggaggtggcgtcctgaggaaggaggggatcgccaaaggggagggtcccaggccgtccaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaactttttaa

SEQ ID NO: 14258 - DNA, 1031 bp, Homo sapiens
cgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaag

SEQ ID NO: 14259 - DNA, 631 bp, Homo sapiens
gcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcag

SEQ ID NO: 14260 - DNA, 1740 bp, Homo sapiens
cccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 14261 - DNA, 4356 bp, Homo sapiens
tttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagata

SEQ ID NO: 14262 - DNA, 3564 bp, Homo sapiens
atagcaccaggtgtgaaactgctgggtcatagaagatacagtcacgagttgcttaaggctgggatacatcctgagaaatgggtcgttaggcaattttgttgttctatgaacatcatatgaacaaacctagatggtacagcctattatacacttgggctatgtggtatatagcttattgtatctaggctataagcctgtacagcatgttactgcactgaatactgtaagcagttgtcacaaaatggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctg

SEQ ID NO: 14263 - DNA, 530 bp, Homo sapiens
gacaaagcccctccttccccttcccgccgttcgcctatcgccttctctctctgccggtcgcatgcgcgctggtctcctgtgacgtagttttcgcgcgtccgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacgctaaggagacaccagagggtgatggttgacagtagttggtacctcacagctgggcactgatcaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtact

SEQ ID NO: 14264 - DNA, 554 bp, Homo sapiens
acatgcttttaatgaaaaagtgaaggtagttgtccgtttatagagaggagcttcatggagaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacga

SEQ ID NO: 14265 - DNA, 584 bp, Homo sapiens
actgccgggaattggagtcacagagggaggaaggccgaaccgcgggagcctacagatcccagaagacaccgcgctaccgaggactgcagtctggagttggagcccttgtcccaaccagggctggataagaaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattact

SEQ ID NO: 14266 - DNA, 2953 bp, Homo sapiens
ttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatacctc

SEQ ID NO: 14267 - DNA, 6191 bp, Homo sapiens
gttctatccggggccttggcgcttctctttcctttcgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcactatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtggggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaacatc

SEQ ID NO: 14268 - DNA, 5325 bp, Homo sapiens
acagcagcatggcggccgccgacgggaggcggtcatagcatcacgcccgggggaagaggccgccgtaaaggaagctctgcttcctcttcttccttctcccgcctcccaccggctgtcgtaaaacggtgaatggagagcgagttgtgggggggaaaaagggaggacagggggcgcggagtcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcagtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttcttcagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccagga

SEQ ID NO: 14269 - DNA, 3212 bp, Homo sapiens
attgttgtatatgcagtctgtcactgaccgaaacatttgttatgtggtgcatgactttatatacattttttccagttagagtgtaagcttcgtgagggcaaagattgtctatcttattatgtctgtagcatgtagcatgttttgtactgaatggatgtggaggcaatatccgtcttctgcaactcacagtacagcagaggtgagccatatatctgtttagtacaaagtggactgtagttattatgctacagtgtagaggaaagtaatttaaaaaaatgtttcatgagtgtttaatgaaataaatattttcatcaaggtggttaaaatggaaagtttgaccctcaaagggtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttcttcagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaa

SEQ ID NO: 14270 - DNA, 3413 bp, Homo sapiens
ttatcatctgggcatgaattagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccagg

SEQ ID NO: 14271 - DNA, 4169 bp, Homo sapiens
gaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgag

SEQ ID NO: 14272 - DNA, 679 bp, Homo sapiens
gaggagtctgtggtgaggatttgagctgcgtccagcattggatatttgtcaggaatgcagataccctgaagggaacacaacaatggtccaagggggtttcccagaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggt

SEQ ID NO: 14273 - DNA, 8595 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgttctggaggctgggaagtccaagagcatggagccagcatctggtgagggccttcatgctgcatcatcctgtgacagaagttgaagggcaaaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttttttgagacggagtctcactctgtcacccaggctggagtgcaatggcgcaatcttggctcactgcaacctcggcctcccaggttggagcgattctcctgcctcagcctcccgagtagctgggattacaggcatgcatcaccacactgggtttatttttgtttttttagtagagatggagcttccccatgtgggccaggctggtcttgaacttctgacctcaggtgatctgcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaa

SEQ ID NO: 14274 - DNA, 8505 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttttttgagacggagtctcactctgtcacccaggctggagtgcaatggcgcaatcttggctcactgcaacctcggcctcccaggttggagcgattctcctgcctcagcctcccgagtagctgggattacaggcatgcatcaccacactgggtttatttttgtttttttagtagagatggagcttccccatgtgggccaggctggtcttgaacttctgacctcaggtgatctgcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaa

SEQ ID NO: 14275 - DNA, 8421 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttttttgagacggagtctcactctgtcacccaggctggagtgcaatggcgcaatcttggctcactgcaacctcggcctcccaggttggagcgattctcctgcctcagcctcccgagtagctgggattacaggcatgcatcaccacactgggtttatttttgtttttttagtagagatggagcttccccatgtgggccaggctggtcttgaacttctgacctcaggtgatctgcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaa

SEQ ID NO: 14276 - DNA, 1526 bp, Homo sapiens
agtctgtggtgaggatttgagctgcgtccagcattggatatttgtcaggaatgcagataccctgaagggaacacaacaatggtccaagggggtttcccagaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgttctggaggctgggaagtccaagagcatggagccagcatctggtgagggccttcatgctgcatcatcctgtgacagaagttgaagggcaaaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcaggttgtcgatggcttctcatcagactgactcactcttctgcccccactgggagaaagttccccatttaataaatggttgtttggaaataatatctaatgtacagcatattcacagca

SEQ ID NO: 14277 - DNA, 959 bp, Homo sapiens
gcacacagcctgatggtttcctaagcaggtatgcagagagaagttccacgctatcagtcactaaaggaaccagaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacggtaaagacgtgctgtgggagttgggatctgcctttttcatccagagctctgatgcctgtgaacactgaaagagaaag

SEQ ID NO: 14278 - DNA, 2019 bp, Homo sapiens
atgtctcccgcccggctccggccccgactgcacttctgcctggtcctgttgctgctgctggtggtgccggcggcatggggctgcgggccgggtcgggtggtgggcagccgccggcgaccgccacgcaaactcgtgccgctcgcctacaagcagttcagccccaatgtgcccgagaagaccctgggcgccagcggacgctatgaaggcaagatcgctcgcagctccgagcgcttcaaggagctcacccccaattacaatccagacatcatcttcaaggacgaggagaacacaggcgccgaccgcctcatgacccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgagcactcggccgcagccaagacgggcggctgcttccctgccggagcccaggtacgcctggagagtggggcgcgtgtggccttgtcagccgtgaggccgggagaccgtgtgctggccatgggggaggatgggagccccaccttcagcgatgtgctcattttcctggaccgcgagcctcacaggctgagagccttccaggtcatcgagactcaggaccccccacgccgcctggcactcacacccgctcacctgctctttacggctgacaatcacacggagccggcagcccgcttccgggccacatttgccagccacgtgcagcctggccagtacgtgctggtggctggggtgccaggcctgcagcctgcccgcgtggcagctgtctctacacacgtggccctcggggcctacgccccgctcacaaagcatgggacactggtggtggaggatgtggtggcatcctgcttcgcggccgtggctgaccaccacctggctcagttggccttctggcccctgagactctttcacagcttggcatggggcagctggactccgggggagggtgtgcattggtacccccagctgctctaccgcctggggcgtctcctgctagaagagggcagcttccacccactgggcatgtccggggcagggagctgaaaggactccaccgctgccctcctggaactgctgtactgggtccagaagcctctcagccaggagggagctggccctggaagggacctgagctgggggacactggctcctgccatctcctctgccatgaagatacaccattgagacttgactgggcaacaccagcgtcccccacccccgtcgtggtgtagtcatagagctgcaagctgagctggcgaggggatggttgttgacccctctctcctagagaccttgaggctggcacggcgactcccaactcagcctgctctcactacgagttttcatactctgcctcccccattggggagggcccattccatccatcttaggcccctttgggtgggcttgcgcctcagttgatgctgctaaattccctgggagccagcatggatctggctggacccgatgctgtccagaactgggaaggccacaggggtggggcagccatcccggccattctgaggtatgacattcctccccggccacactcctcaagacacatccagagactgttgctgtctgtgggcagagttctgtgttctggccaatgtgaccgtagtgccggggactgggggaggtgggttggatgtgcttgccacccccccggctaagctcccccttctgctgaaccatgatccccaccccctccgccggtcagtctcccataccttatttattggagtggagggggaagcccatgggagaattttggggatgttttggtcttttcttccttttgtaataaaaattatttaagttgttaga

SEQ ID NO: 14279 - DNA, 2097 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaa

SEQ ID NO: 14280 - DNA, 612 bp, Homo sapiens
ttttctcctattaatctgctttgtcatttgattttcaatgaaccttcagagggcaaaaggaaagttttccctcagctccaacagttttggcccagtgaacaggacaaccaaaactgctctgctcttccgaaaattgcagtcagggaacctgggacccggcaagccagcagaaggaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtgacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 14281 - DNA, 1138 bp, Homo sapiens
gaacaggacaaccaaaactgctctgctcttccgaaaattgcagtcagggaacctgggacccggcaagccagcagaaggagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 14282 - DNA, 1709 bp, Homo sapiens
aggacaaccaaaactgctctgctcttccgaaaattgcagtcagggaacctgggacccggcaagccagcagaaggaggaacgggcaacttggtttcttctttagcttccttgttctcattaagattgaacaatgcctctaaagtgaaccacagacttgcatgcaagctgaaaacctttaccaaatgcagtcttaatttgtactttgagaaaaacattttcaagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaat

SEQ ID NO: 14283 - DNA, 572 bp, Homo sapiens
aaccaaaactgctctgctcttccgaaaattgcagtcagggaacctgggacccggcaagccagcagaaggagttaaggaaaatgtttgttctgttaagctttacagaaatggaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtgaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctg

SEQ ID NO: 14284 - DNA, 1227 bp, Homo sapiens
atggagccccacagaccgaatgtgaagacagcagtgccattgtctttggaaagctatcacatatctgaagagtatggctttcttcttccagattctctgaaagaacttccagatcattataggccttggatggaaattgccaacaaacttcctcaattgattgatgctcaccagcttcaagctcatgtggacaagatgcccctgctgagctgccagttcctgaagggtcaccgggagcagcgcctggcccacctggtcctgagcttcctcaccatgggttatgtctggcaggaaggagaggcgcagcctgcagaggtcctgccaaggaatcttgcccttccatttgtcgaagtctccaggaacttggggctccctcctatcctggtccactcagacttggtgctgacgaactggaccaaaaaagatccagacggattcctggaaattgggaacctggagaccatcatctcatttcctgggggagagagcctgcatggttttatactggtgactgctttggtagagaaagaagcagtgcctgggataaaggctcttgttcaggccacgaatgctatcttgcagcccaaccaggaggccctgctccaagccctgcagcgactgagactgtctattcaggacatcaccaaaaccttaggacagatgcatgattatgtagatccagacatattttatgcaggcatccggatctttctctctggatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggttaggag

SEQ ID NO: 14285 - DNA, 2294 bp, Homo sapiens
agtccagatgatagttaagaaagcagtaagaatacagagagtccacaatgagatgaaaatgcactgccagttgaaacatcctcctacactggagctttataaatattttaaagacaaggattggattagatttgacattagaaatgtaccataatacagaaggcaatggacacctaaagaacagaatgaaaaccttcttaggaaatgaagcttgacacttcacccaccaggccaccacaagaatgttgcattttcattattatgatacttcaaacaaaataatggagccccacagaccgaatgtgaagacagcagtgccattgtctttggaaagctatcacatatctgaagagtatggctttcttcttccagattctctgaaagaacttccagatcattataggccttggatggaaattgccaacaaacttcctcaattgattgatgctcaccagcttcaagctcatgtggacaagatgcccctgctgagctgccagttcctgaagggtcaccgggagcagcgcctggcccacctggtcctgagcttcctcaccatgggttatgtctggcaggaaggagaggcgcagcctgcagaggtcctgccaaggaatcttgcccttccatttgtcgaagtctccaggaacttggggctccctcctatcctggtccactcagacttggtgctgacgaactggaccaaaaaagatccagacggattcctggaaattgggaacctggagaccatcatctcatttcctgggggagagagcctgcatggttttatactggtgactgctttggtagagaaagaagcagtgcctgggataaaggctcttgttcaggccacgaatgctatcttgcagcccaaccaggaggccctgctccaagccctgcagcgactgagactgtctattcaggacatcaccaaaaccttaggacagatgcatgattatgtagatccagacatattttatgcaggcatccggatctttctctctggatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggttaggaggctgccctctccccagcaatgcagagcccccatggagggcaggtgggcctggagaatgagggtcagggttctgcctgggatcatccaggaaggatctcagccctattcatgtttctgctctacagagcactatattctccttgttgagagctgttggcttcacaaaggagagttgatgtggccaagcctttccctccctacctgatcactgcttaacggcatgtataatggatacttcctcatgcagaacccccagaggagtgactgtatgccattctctttgccaagtaatagaaaaccaatctaaatgtcaaaaatcagataaaattgcctggggatacattacttgttgattttcttaaaaaacaaattcacttaacaattcattaagttcatactgagcactgcctccaagattaaaaccaggatttctgtggtcccagaccagccctcttctccctgaatgtgttgagttggtggcaggaggttggaaatgctccagtggagatgggaagatagaggatgctgacaataaggacttggaagtcactagtgtgaaaatgagcagttaatgatatgggaacggatgagactttccacgtggtacctagatttgcaaattctattgtaatgcctttatttttagaagaattattctctcttcttactctgaaaatctgtatttgtaaaatgaatgaatggatcctatataagtaaataagaaaactgggaataagtagtaaatcaatgtgtttagtgtgcaaataaatgtaaatgcttttattg

SEQ ID NO: 14286 - DNA, 2559 bp, Homo sapiens
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctgagccaggagggccagccagaggtctggtcaggctgtgaggccttggccatctgtatgctagagaggggtgaggaatggatactgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcccgagtagctgggactacaggagctcgccaccacacccagctaatttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagatggggtttcaccgtgttagccaggatggtctcgatctcctgacctggtgatccacccaccttggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggtcagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtgtgtggaagccacgggctcaagcagccaaggcagggcggacagtgtgagagagctagtgtaagctgttgatgagagctgttgctgaataaaaccatattcacctgcc

SEQ ID NO: 14287 - DNA, 803 bp, Homo sapiens
atttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctga

SEQ ID NO: 14288 - DNA, 2645 bp, Homo sapiens
cgagagcctgaattcactgtcagctttgaacactgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 14289 - DNA, 2528 bp, Homo sapiens
ctgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 14290 - DNA, 1009 bp, Homo sapiens
ggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaaggaaaaaa

SEQ ID NO: 14291 - DNA, 2907 bp, Homo sapiens
agagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 14292 - DNA, 7080 bp, Homo sapiens
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtgcctgtatccagtggctttggtgggtgcagggagtcttgggcacagccagctcagctgtctgtggtatgagcaggaacaggtgccactcctgctcaggggaccctgccctacaccaggctgttccgtccccctggaggacatggggccaggtctggaggcattttgggttgtcacagctgggggctgttcctcggcttcagcgggtggaagcctcagatgctgttcaacatcttctggacacgggaggccccgacagagagaagcgtccacccgcaagtccacagtctgaggtctcccctcagagaccctgccctgcacacccacctccagccaaaggtcctgcctgccccagggctcaggggaaccttgccggtctgtggaacaggagaggggactctcgccagctgcaccaccctgcacgtagtaggtgtgcggtaaacatccaccagggaggctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaaggggcaagactccagaggcctcctctctgcatctccttgtcttcagtggccggaggtgaggcctgagctcaggggaggggcttctgccacgaaccctatggcggggcacagcacacttttcccagggaggacccctgggccccctgcattatccccagcggagtgtggggtcaccttccaagagcgacattgagaagctccagctctaggagtgtgcagactcttaaccaggcaggcccaggccctggggcacacaaaggcggggcctgctctccccagctgcccctgccaatgggggctggactgtcctaccctcctcccttctacctccccactgtcttccctctccactgtcaccactgcctccctcttccactgtcctccatgcactgccctccctccaccttcccccacccccaccactccccatgctgtccccaggctccccccgctctcccccctccccactgtccccctccccatgctgtacccagctcaccccgctctcccctctccccactgtcccccctcccactccccatgctgtccccagctcaccctacatggacttggcgatgtccttccatggctcaccggtctgaatttccatgatgagccgggcctgcagctttgctcccctatccctgcccaggctgcagctgtccatgcagggagcgagctccagcacctgcggagtccttccgtgggggcctctccgtgccacagcagccagggacctcaggtgcctgtgcatgacaccaccgcccatcctcatcctgagccagcctctcaggatcaggacttggtttggcggcgttaaccttagagcctgcaaggggcttcctcctggtgggtctggccgtagcctggggaggccacagctccaggccactccagacctcccttcctctgggccttccatgtggtggcaaccaccgcagctgtaagggagggaaaatggagcgtttgttctcgggctgggctggggtctgggggaagccatgggcgtgaagactggagtattatttgatggagaagcggccactcctggagaccggcggcaaacacagaagcacagcgtggaaggtgctggtgtcagcccacacgggtgatggggtcagactcaggagtcacactcaggagtcaccaggctcaaagggcccaggcaccgcaagtcctgctcagccccagacacaatgcattcctgttgccctcgccctcagccaggccccacgcaggccagggagcactggcaaagcttggcaaccctctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccgaactcaagcaattctgcctcagcctcccaagtagctgggattacaggtgtgcgccaccatgcccaggtaattgtatttttagtagagacagggtttcaccatgttggtcaggctggtttcaaactcctgacctcaaatgatctgcccacctcgacctcccaaagtgctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctccactaaaaatacaaaaattggccaggcacggtggctcacacctgtaatcccagtactttgggaggctgaggtgggcagatcacctgaggtcaggagttcaagaccaacctgaccaacatggagaaaccccatctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaagaaaaaaattagttgggcacggtggcaggcgcctgtaatcccaggtactcaggaggctgaggcaggagaattgcttgaacccgggaggcagaggtcgcagtgagccgagattgcaccactgccctccagcctgggtgacagagcaagactccgtctcaaaaaaaaaaaaaaaaaaaattggatacattgtaatacctcaaatacttgtaagtgaagcaccccagttcccatagagctgccgcactcagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaa

SEQ ID NO: 14293 - DNA, 1468 bp, Homo sapiens
gccacgggcaggggcaactcggactgtggggcgtggaaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatgacttgaca

SEQ ID NO: 14294 - DNA, 6064 bp, Homo sapiens
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgta

SEQ ID NO: 14295 - DNA, 1632 bp, Homo sapiens
ctccctgacagccacaaacctacagcactgactgcattcagagaggaacctgcaaacaaaacttcacagaaaactttttgttcttgttccagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaaca

SEQ ID NO: 14296 - DNA, 3204 bp, Homo sapiens
actcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggatccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacagatggcctcgcctcctcccgggtccgcctatacttcttcatctccaacgaaggcaaccagaacctgtttgtggtccaggccagcctgtggctttacctgaaactcctgccctacgtcctggagaagggcagccggcggaaggtgcgggtcaaagtgtacttccaggagcagggccacggtgacaggtggaacatggtggagaagagggtggacctcaagcgcagcggctggcataccttcccactcacggaggccatccaggccttgtttgagcggggcgagcggcgactcaacctagacgtgcagtgtgacagctgccaggagctggccgtggtgccggtgttcgtggacccaggcgaagagtcgcaccggccctttgtggtggtgcaggctcggctgggcgacagcaggcaccgcattcgcaagcgaggcctggagtgcgatggccggaccaacctctgttgcaggcaacagttcttcattgacttccgcctcatcggctggaacgactggatcatagcacccaccggctactacgggaactactgtgagggcagctgcccagcctacctggcaggggtccccggctctgcctcctccttccacacggctgtggtgaaccagtaccgcatgcggggtctgaaccccggcacggtgaactcctgctgcattcccaccaagctgagcaccatgtccatgctgtacttcgatgatgagtacaacatcgtcaagcgggacgtgcccaacatgattgtggaggagtgcggctgcgcctgacagtgcaaggcaggggcacggtggtggggcacggagggcagtcccgggtgggcttcttccagcccccgcgggaacgggggtacacggtgggctgagtacagtcattctgttgggctgtggagatagtgccagggtgcggcctgagatatttttctacagcttcatagagcaaccagtcaaaaccagagcgagaaccctcaactgacatgaaatactttaaaatgcacacgtagccacgcacagccagacgcatcctgccacccacacagcagcctccaggataccagcaaatggatgcggtgacaaatggcagcttagctacaaatgcctgtcagtcggagagaatggggtgagcagccaccattcccaccagctggcccggccactctgaattgcgccttccgagcacacataaaagcacaaagacagagacgcagagagagagagagagccacggagaggaaaagcagatgcaggggtggggagcgcagctcggcggaggctgcgtgtgccccgtggcttttaccaggcctgctctgcctggctcgatgtctgcttcttccccagcctgggatccttcgtgcttcaaggcctggggagcctgtccttccatgcccttgtcgagggaaagagacccagaaaggacacaacccgtcagagacctgggagcaggggcaatgaccgtttgactgtttgtggcttgggcctctgacatgacttatgtgtgtgtgtgtttttggggtggggagggagggagagaagagggggctaaatttgatgctttaactgatctccaacagttgacaggtcatccttgccagttgtataactgaaaaaggacttttctaccaggtatgaccttttaagtgaaaatctgaattgttctaaatggaaagaaaaaaagttgcaatctgtgcccttcattggggacattcctctaggactggtttggggacgggtgggaatgacccctaggcaaggggatgagaccgcaggaggaaatggcggggaggaggcattcttgaactgctgaggatggggggtgtcccctcagcggaggccaagggaggggagcagcctagttggtcttggagagatggggaaggctttcagctgatttgcagaagttgcccatgtgggccccagccatcagggctggccgtggacgtggcccctgcccactcacctgcccgcctgcccgcccgcccgcatagcacttgcagacctgcctgaacgcacatgacatagcacttgccgatctgcgtgtgtccagaagtggcccttggccgagcgccgaactcgctcgccctctagatgtccaagtgccacgtgaactatgcaatttaaagggttgacccacactagacgaaactggactcgtacgactctttttatattttttatacttgaaatgaaatcctttgcttcttttttaagcgaatgattgcttttaatgtttgcactgatttagttgcatgattagtcagaaactgccatttgaaaaaaagttatttttatagcagcaaaaaaaaaaaaaaaagaatacagttaaatgtattatacataattttggaaccaaagaggccaacagatcagttttaattttattagacggtgaggccatctgagatgaggtggacgttctgagcagtcccttgagtggcctgccaacgtttcagggtatgaatggattttgtttattcggtttgatgtgtcttttccatccttacacacccagaaggtagagtaaaaatgactatgatagaatgcaggtgtgtatccttaaatcctcatctttatgtttatttaataaagctccccttagattctgtttcataataatttaaaaccaaacaattttcccatagacttgctgttaaagtattgtacgtttgtgtacagtttaagaaaataaaagattgagtgccacgggc

SEQ ID NO: 14297 - DNA, 1992 bp, Homo sapiens
caaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaagggctgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgatat

SEQ ID NO: 14298 - DNA, 2429 bp, Homo sapiens
agctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaa

SEQ ID NO: 14299 - DNA, 6054 bp, Homo sapiens
cttcctctacatccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcactaatgtgtgcttgacattttttactatattgacatttattatggaaagagttaataattattttttctgatgtgctacactagtggccagtatatggttaagttgatgctgtatttattctaagacggatttaaaaaggcagttttctaaatatgaacttgtgaatttttgtatgtgtgtttgagtaaattgagaaatgaattttataaatgttctattgatgttgcagtaaagaagccttttgaagtaattga

SEQ ID NO: 14300 - DNA, 2041 bp, Homo sapiens
gcgcgctgagtgacggcgcggttgccatggcagccgcctgagcggcgccgcgaggacaaggctgcagggcggcgtgaatgggcggcgtcacgcgcctggcgccagagagtctgctccggggctccggctccggccccgccgcggcctggcccgcgcgccgccgccgccgccaccgccgccgccaattcatcacctgtcagggatcactcgcggggtcacgggcggaatggacacagctgtgagaacaaaacccgggaaagaaaggcgaacgctccccattgcgccagatgtgcagggaggaccttgagacgcgccccccgcccccgcaggctcctcccgccccccggcgcatcacgcgggggtggcaaaggcggcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagctgggctcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 14301 - DNA, 623 bp, Homo sapiens
attctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttg

SEQ ID NO: 14302 - DNA, 1362 bp, Homo sapiens
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtc

SEQ ID NO: 14303 - DNA, 1251 bp, Homo sapiens
gatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcactccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtctcttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 14304 - DNA, 2344 bp, Homo sapiens
aggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgta

SEQ ID NO: 14305 - DNA, 1189 bp, Homo sapiens
cgcccctgggctggtgctgcgggggcggggagtgagggctgctctggggggagtggagatcggggagcgcggccgtgccctctcgagcggctgcggggtccccgcggcgccgggctgctgagctgagggcccgcggcggccgcggccggtgcatgtgcggctgctggatgcggaggcggcggcgacggcgcggatcggcaggatgttagggcagcagcagcagcaactgtactcgtcggccgcgctcctgaccggggagcggagccggctgctcacctgctacgtgcaggactaccttgagtgcgtggagtcgctgccccacgacatgcagaggaacgtgtctgtgctgcgagagctggacaacaaatatcaagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttg

SEQ ID NO: 14306 - DNA, 783 bp, Homo sapiens
agtccgaatcggggtttgcagcatgttttgcggtgatgtttccaacctctttcccagtcaatggatcaggacggcgatcagcagctcggaccgtcgcggatcctggctccgcaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtag

SEQ ID NO: 14307 - DNA, 3777 bp, Homo sapiens
tttttttttttttctttttttttttttgccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctccctaaacaagttaggttcatttgtgagtactcatcatttcataatatcatgattatcacgatttcatgatactcaatattttgagattttataaccctttaagaagtgataaataatgtagtattcaattcgtttatcaaagtatattgcctggaaatgctcacatgtatcatttacatcctctatatattatgactattccaaactcattcattttatagaaatggtcaaaggaaaaagccttatgtacagccttatttgaagagaaagttctttgtctgagtcaggaacatcctgttatccagctgctacatcccctttcagtgtgaattccactccttaccaaatcacttagaaaacactttgacaagttttaaactcaaacactgaatattttatgaagcatgtgtaaagaaagaaaccaaaatttggtgcaggtatttagtaatgggtagaacctgttaatatctgagtcatatataatggggccaaacatggaactacctcatcaaccccccaaaaatgtggccaactattaatattctttgtgacatttacaccaaggggcatagtaagtatttttggtattataaaatacacattcaaaatctctgttgtacaaaactcatgtaacagttgggacaaaatatccaaatgtgggttcacagttcacaggtggtgaaaattgaggccttactgctatggagtgtatatcaaaatgttcatggtgacacatttgaagcaataaatggcttaattaaatgccaaaa

SEQ ID NO: 14308 - DNA, 1222 bp, Homo sapiens
tttttttttttttgccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttgcagcacttctaaaagattgaaaacaccaagaagatagatagaatattcactatttctcatattgatgcaattgtggtgctctttttcatttgaaacatcttctcctaaaatatacactttaagaaatagtcatttctgtttttgcattaaagtaaattaaagcagaaaacacatgctcacttttggctaacttcagtgtatagatttcatacttatgttgtctttcctgggtacagatttattactgaacaagtacgtgtaagtaaaatgtcattggtgagcaggacacaagataaaaggtgaacaccacatatggtgtgaattgtaaatgcttataccacaaacttgaaaatgtgtcatgtagagccatggaaaatgtctagttgtttttatgtagtacacacattttaatggtgctaacaacctgggctcttttgttcatagagttattctgaaaaaaatttcataaaagacactgcctaaagataggtagaataggctgtagcttgatttactgtggaataaaaaccaaaaaaaaaaaggtcttaattgtttcagtctttaattatgtctataaacttagaaaaaggcatttacatttgaatctagactaatttgtttagtaacattcttcctcatattcaatgactgtatgtatcagtccttatttagagactgcctgctttttaattcatatagctctttggttctattctttgttttgtttattattttgttgttttattgcttgttagacctttactaaagatattttgtgtatttagaaaaaatataacataaatatatgctttttaaatatg

SEQ ID NO: 14309 - DNA, 5196 bp, Homo sapiens
gaccccgagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccggtacagcccgggctccgcgtgccccgcccgctggagcacctgccaccgaggcgcgcgtggggccactgccgtggcggcggctgccctcctcacactcggctccgcgccgcctccggccaccgtgcgctcccgcgtggggcgcctcggatgggcccgggagggctgggggctcttccctggaggaagcggcctccgcttcgctggcgccgcctttttagcttggacttcagtcctccctcggggactcacctccggagtaaacggctcttcattagcttggagtggccgcaggtcccgtgaccagcacccgcgagaccctgtgcgacagctgggctgatgctccgtttctctgggaattggtgattttttactgtgaagatgaaattaccctaatagcatgaagatcgtgggtctgtgtgtccgtgaagtgagtcccgtctgccaggagctgacgaaccacgaatgcttctgcctgtgctgtgcattcccaggcccgcagctcccggtcgaggggactccgatgtgaatttgttgtgaatttgttgtgccacaatagcagttctggaatgaagctaggaaactcgagtgtgctttttgtttaatgagcgttcaccaagctgagccggagccatcctttcggtggtagttggggaaggctatgcagatttgctctgttgtgacgcgttggtgacggtgcccagcctgcggttccccacagcatcgcaggcgctcggaaatcctctcccgtgcctttagaggaaggagaggattgctgaggaatgcagggacgcctgtttctgtcctcacaccacagaaagaaacctgagggaaaactgagacgtgaggttcctgatttaagaagcctgggtttcttcatggtggggggccatttggaatgacagcctcacttccttctgatggctacatctgtatcttttcctcctgtgtttaatgtttcactagggagaggaaataaagcagaaggaacgtgtgaagctctgtgtctcagacggggccctcccgtcgagaagctggtagtcagtgagtgagaacaagagaacaagaacaccctgaacagtcctggttgggatggtgtccacattcatgttctgcggttcttgaacacacggatgcctctgggccacctgtccttttccgagggtgtgggtgggagtggatcctccgggcgcaggtgccaggcaggtgcaggcgggcggtcggccactgctgctgctcgtccctgccagtgtctgggcctgaaggggctccctccaagcggtgccttcctgcggcttagaagggaaagcgccagagagggcaggctacagtgcttcacacccttcgccacggctgtgaaactggagatgggtgggttttgtatgttaatttttttttttgagacggagtcttgctctgtcacccaggctggagagcagtggcgtgatctcggctcactgcaagctccgcctcccgggttcacgccattctcctgcctcagcccccccgagtagctgggactacaggcgcccgccaccacgcctggctaattttttatatttttagtagagacagggtttcaccatgttaaccaggatggtctcgatctcctgacctcacgatttgcccgcctcggcttcccagagtgctgggattacaggcgtgagccaccgcgcctggccacccagctaagtttgtatttttgttggagacggggtttcaccatattggccagactggtctcaaactcctggggtcaaatgatccgcctgcgtcggcttcccagagtgctgggattacaggtgtcagccactgcgctcagctgggagatgaattttcatttaatgacttaactttttgttagcacaggttttgtgtgtgtgtgtgtgtgtgtgttttgttttttgttttgtgtttttgaaacggagttttgctctgtcacccaggctggaatgcaatggcaccatcttggctcactgcaacctctgcttcctgggttcaagtgattctcttgccttagcctcccgagcagctgggattataggcgtccaccaccacgcccagctaatttttgtatttttagtagaaatggggtttcaccatgtgtggccaggctggtctcgaactcctgacctgaagtgatccacccgcctcgacctcccaaagtgctgggatgacaggcatgagccaccgcacccggccaacacagatgtttattgatcgtggaggatacattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttctacccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccaagcggaggcctgcgtggcctcctgagcagcagctgaccgcccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcttaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaacaaa

SEQ ID NO: 14310 - DNA, 946 bp, Homo sapiens
gagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatgatttcatttaaataaaaacctgtagtctgggcaacatcgggagaccccaactctacaaaaaatacaaaaattagctgggcgtggtggtgcgtgcctgtggtcccaactacctgggaggcggaggcgggaggatggcttgagcctggaagtccgaggcttcagtgagctgagatcgcgccactgcactccagcctgggcgagagagcaagaccctgtctcaaataaataaataaaaagataaaaacc

SEQ ID NO: 14311 - DNA, 2403 bp, Homo sapiens
aagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctg

SEQ ID NO: 14312 - DNA, 1654 bp, Homo sapiens
aagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggaggaagctggcccagttgcaggtggcctatcaccagctcttccaagaatacgacaaccacatcaagagcagcgtggtgggcagtgagcggaagcgagcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 14313 - DNA, 2778 bp, Homo sapiens
agtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcatttt

SEQ ID NO: 14314 - DNA, 2501 bp, Homo sapiens
ggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactg

SEQ ID NO: 14315 - DNA, 3086 bp, Homo sapiens
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctac

SEQ ID NO: 14316 - DNA, 5905 bp, Homo sapiens
agtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttcccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 14317 - DNA, 3823 bp, Homo sapiens
gggtgcggactgtgggagctgactctgggtagccggctgcgcgtggctggggaggcgaggccggacgcacctctgtttgggggtcctcagaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttg

SEQ ID NO: 14318 - DNA, 3269 bp, Homo sapiens
agtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaagtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgcctttctccctgggaagcagcacagctgagactgggcaccaggccacctctgttgggacccacaggaaagagtgtggcagcaactgcctggctgacctttctatcttctctaggctcaggtactgctcctccatgcccatggctgggccgtggggagaagaagctctcatacgccttcccactccctctggtttataggacttcactccctagccaacaggagaggaggcctcctggggtttccccagggcagtaggtcaaacgacctcatcacagtcttccttcctcttcaagcgtttcatgttgaacacagctctctccgctcccttgtgatttctgagggtcaccactgccagcctcaggcaacatagagagcctcctgttctttctatgcttggtctgactgagcctaaagttgagaaaatgggtggccaaggccagtgccagtgtcttggggcccctttggctctccctcactctctgaggctccagctggtcctgggacatgcagccaggactgtgagtctgggcaggtccaaggcctgcaccttcaagaagtggaataaatgtggcctttgcttctgttt

SEQ ID NO: 14319 - DNA, 2487 bp, Homo sapiens
caccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtgggaaatccggagagctggttgctgtgaaggtcttcaacactaccagctacctgcggccccgcgaggtgcaagtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggc

SEQ ID NO: 14320 - DNA, 1751 bp, Homo sapiens
tggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatg

SEQ ID NO: 14321 - DNA, 2103 bp, Homo sapiens
agcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 14322 - DNA, 2286 bp, Homo sapiens
gttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 14323 - DNA, 1972 bp, Homo sapiens
catggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 14324 - DNA, 2056 bp, Homo sapiens
cctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 14325 - DNA, 940 bp, Homo sapiens
ccacgctccaggccgtttgttcctgctgctccctttgggattaactagagattgaaccggctcaccttgtttcagctcaggccctgcaaccgaccgaccgtctgctgggctccaagtcacctgagaggcgaggtgaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcaggg

SEQ ID NO: 14326 - DNA, 960 bp, Homo sapiens
acagactccagaaaggtactggtggcaggggactggtctgctgagtcacagcaaccccacgctccaggccgtttgttcctgctgctccctttgggattaactagagattgaaccggctcaccttgtttcagctcaggccctgcaaccgaccgaccgtctgctgggctccaagtcacctgagaggcgaggtgagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtggg

SEQ ID NO: 14327 - DNA, 693 bp, Homo sapiens
gagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggac

SEQ ID NO: 14328 - DNA, 1949 bp, Homo sapiens
gaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 14329 - DNA, 2545 bp, Homo sapiens
ctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgagtacaacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatg

SEQ ID NO: 14330 - DNA, 1520 bp, Homo sapiens
gcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagc

SEQ ID NO: 14331 - DNA, 2088 bp, Homo sapiens
caccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagt

SEQ ID NO: 14332 - DNA, 3001 bp, Homo sapiens
aattctctttaagagtcacagctgtccattttccacgtgcggctgaagaatggatttcagagcgctctccctccggcagtgttcacctagtaaccccttccggataaggacctgcagcccgggcgcgacccggaaagggaatccgcccttttcgcctccttcgcgccaatcgcctggagttggcgtttccgcagccgggacacagcccaccctctaagagccgcggagtcggggacggtagaaggggccgcgcgtgcgcagtggcgtccgctgtgcttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactga

SEQ ID NO: 14333 - DNA, 2627 bp, Homo sapiens
agcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 14334 - DNA, 2670 bp, Homo sapiens
gcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactga

SEQ ID NO: 14335 - DNA, 2608 bp, Homo sapiens
ctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgagtacaacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatg

SEQ ID NO: 14336 - DNA, 5122 bp, Homo sapiens
accagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaattgaggtgtctgtggtctttgcagctgcccctccttggaggcaaactagagcccttggtggatgtggcaggatacagggaaagcagagccctcgcctgtgatcagagaggacaggggttggtgggacaaggagtggactgtgggtgtttccttagtagcagaattgattgggcttatgaatttgcctctggccatcagaaaggaagcttgaccaactgtctgacatgcagtggtcaacgcccttgtctccatggtgggctctttatgactcaggacttagaccccaggactgaggtgtgggcggcttggcctaggcgccattaagcagagctacatagtggtcatcttaatagtggcagtgttctcaaagttagctgcactcttaagaatcatgaaagaaaatggtgaaatacattcctaaggatgccagagacatccaggctgtgaaaacttaccttggtgatagttgggaaaagagccctagttcccagcctggcctggcagccagcgtttctctgactgggtgaaacactgataagctcttgtatcacttttgggtagggctcatgtggttcccaagtatgctggctgtgtggcctccctagccttgctcaccctgcacgctgttggtcagggtgggctggctcctgggcagctgatgcccaccacagtcacaaggatcagcctttcttcattgacatcaagtacattactagatactctggatcttgtttatcttgctggtgaacttgaccaaggcctcacacagaataaaccaacatcagaactaagcagctctgcctttacatgctatgtaaagatttttcataagaaaagatagtaatttgaaacctgaattgtcccttaaggcaacgcttctccagtgttaatgtgcacacaaatcaccttgagatcataacatgcaagttctgtttctgaaggtctaggttgaggcttgagactgagtttcttgagaagatcccaggtgatggccatgctgcttgctagtccttggactacccctggaataacaaggccctagggtgccttccagccctgccaagcaggaaaaatctctgctctttgcttatatgcccgcaccccagccaggaagcccggtgcaggaaatactttatttttcctcttacccagcttaatacacctgatgacagaaaatgaaatcctagcatttctagagaaattcaatcccttatatgttttctccatttttgttttgttttttcatttttaaactaactgttcatcattttctccatcacttcctgggtagcacctctgttgggcatgttaggtatgagagaaggcctcagatttgctactgtccctctcctgtgtggcctccaccaagatgcaatatgtcatgaagagtctgtgacccctggactcagtgtttcctgtgcctgtgtccttttattgtgaccaccagactcctggatcagtcatctttctcaactaattcctaagcccctctcagggggcatggagaccgtttggctgctctcccacgcttctctgagactaccagagagtcgcgaaacccccaactggggaggcagcgtgttgaccatgggtgcccagttcagccagcctcatggtgcacattcagaccacttagatggtggggtagggagaaggcaggttgtgttctagagaaagcagagacgtccggttgtcacgaaattgtgtgtccaagtactaaggcggcccactgcctcatcaaaggaccctgaggaagctgggtgcctcccttatctggcctcttcctgcgccctcatttctttcttgcttcaggtcctgggacttagctggcttccctttcctcttcaaaactgccaccacccactctctcgctccagtttctcccccaacccccacccccgtggcaagctgctgggggatggactcctggttctctcctagctgctgccagaagtgagcatcatgcttttcttttttttaaattaaggattttcttgctcatcacaacaaggacaccaggcaaaaacaatactgtatacagagaattacaaagcttgagatacttcacagtcctcacagaatccctgcctacagttcctggcacctttggtgagaaacaaggattcctgagggagaggctcctggactcttacctccttcctagagagctgagttctttcttccagaaaggcatatggaatgtgcatctgtgagtgcccacaaggcctctgctctcctgccacttgggatttcattgttctggcacacaaatctcaaagataaatatgtggcccaaggattggggaggcccctctgggtctgacttggcaacagcctcaggggaagaaggaagggggcacagaggttcaaagttggaggtggtggggagttttctaagtttgctcagctgatgcccccctaaagcagctctgggagagaatgcccggcctcagctcagaatgttccaccctcctaccacccccccagcacatcaccacaaaccccaccctgaactagaggcccaccccccaagctgttcctggctgccagagaagaaaggagctcccctcccatttcccagatgagaggtcccagaagacctatgctgctccatgccttgcacccttgaagagatggtgccagttacctggggatgtctgagcagagtggtggggagagttcaggtccaatggattgtcagtgcagttcagcttcagcagtcttagtttgccttcggcccggtggaattgggaagagcagcataaactcttacctagaatttttctgaatagctaagtctttcagagggctaacattttaacccggtattctaagcaccagaatttggcttggttagaactctcttttaaggatactgtgtcactgcatggctaaacagaacataccgaacataccttaacctttcctaagggcttggggtcatgtgggcatctggtgctctcaggcccactgggacgtactactgtttcccctggattaaatcatgccaacagctacactgccacaaattgtctgtgagacaggattttgctctgtcacccaggctggagtgcaatggtgcaataacagctcactgcagcctcgacctcccaggttcaagcaatcctccctgatcagcctctaccatagtgctggggttccagccacagttcttaagctctgaatagt

SEQ ID NO: 14337 - DNA, 6439 bp, Homo sapiens
aggcgacgagcagtgagtgtgggcggggtgggggtaagccacccgtgtagcggctcgattgttctggcctggctatggcgcctctcctcccccccgccatggctccccgtgtccctgctccgctcctctcagtgagtgaaagtggccgccgccgccgccggcccagcgcccgcagccgcctcagcgccgccgccatcttggggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaa

SEQ ID NO: 14338 - DNA, 5989 bp, Homo sapiens
ggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgag

SEQ ID NO: 14339 - DNA, 1185 bp, Homo sapiens
gcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaccctgcccca

SEQ ID NO: 14340 - DNA, 897 bp, Homo sapiens
ggctcagctgggtaaccggggatcaccatggcggcctcattggtggggaagaagatcgtgtttgtaacggggaacgccaagaagctggaggaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaccctgcccca

SEQ ID NO: 14341 - DNA, 1072 bp, Homo sapiens
tacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttg

SEQ ID NO: 14342 - DNA, 10197 bp, Homo sapiens
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 14343 - DNA, 10197 bp, Homo sapiens
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgagaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 14344 - DNA, 10242 bp, Homo sapiens
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 14345 - DNA, 9858 bp, Homo sapiens
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattac

SEQ ID NO: 14346 - DNA, 10098 bp, Homo sapiens
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaaggaaagagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 14347 - DNA, 10211 bp, Homo sapiens
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 14348 - DNA, 9402 bp, Homo sapiens
atgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgc

SEQ ID NO: 14349 - DNA, 9813 bp, Homo sapiens
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattac

SEQ ID NO: 14350 - DNA, 2799 bp, Homo sapiens
ctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgcca

SEQ ID NO: 14351 - DNA, 581 bp, Homo sapiens
atgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatgatgcaagcttctggatttaatttggttaataaattatctggtgatatcttccttt

SEQ ID NO: 14352 - DNA, 10511 bp, Homo sapiens
cttccagctcccgccgggcggctgtgacggccgcagcgggtcgcagagcagggagtggacacggagtggggagcggagagggaaggaggaggaggaggagcaaaggtgttggagagaaaacttcagaaaggaacaggaaacctgccggggaggcggcggcggctgcggcttctctgggcgcctgggctgcgctcttcgcggggtgtccgcagctgcggcttggccccggtctggcttccccggcgcgcacgcacggctgagccgcgacgctcagtggctcgggccgtgccctccgccgcggctcttggccgctgtagtcccgcgatccgatccgcttctgccgcggcggctccctggagagagggcggcgagggcgcagggaagaagagggacgtccactgtggaacatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcacgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagaga

SEQ ID NO: 14353 - DNA, 9668 bp, Homo sapiens
atttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaatgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccgctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggcccgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaa

SEQ ID NO: 14354 - DNA, 4456 bp, Homo sapiens
gttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccatgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctcgattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 14355 - DNA, 4117 bp, Homo sapiens
ccgccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccatgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctcgattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgg

SEQ ID NO: 14356 - DNA, 1260 bp, Homo sapiens
agccgccatcttgttgttgatccgtacccagtgggcagcgccgggagctggaccaagcggccggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaa

SEQ ID NO: 14357 - DNA, 1775 bp, Homo sapiens
aggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctacgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgta

SEQ ID NO: 14358 - DNA, 1185 bp, Homo sapiens
cattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaa

SEQ ID NO: 14359 - DNA, 792 bp, Homo sapiens
ggtgcgagagaaacaataggacggaaacgccgaggaacccggctgaggcggcagggtctcgctctgtcacccaggctggagtacagtcatgtgatcacggctcactgcagccttgacctcccaggctccagtgacccttccatctcagcctcccaagtagctgggaccacagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacc

SEQ ID NO: 14360 - DNA, 2174 bp, Homo sapiens
cattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaa

SEQ ID NO: 14361 - DNA, 1309 bp, Homo sapiens
gagccaatagtgaggggcaccgggagcgaggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtggggtctttgttggggagtgggggagtcttttgtaaatcaagacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatgg

SEQ ID NO: 14362 - DNA, 1565 bp, Homo sapiens
ttttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactga

SEQ ID NO: 14363 - DNA, 2610 bp, Homo sapiens
agacctcccgcaccagggctctggtgaacagcaaatgctccacgctgggacgggccattgcctgatgcctgtacatggtgggcactgagagacaagattcctgggccctgccttccatacactccccacgatctcggaggaagctctgaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgacttgaagcagccttgaagagtgagttcatgagctcatggtttttctccttgtatggactgctcgctccaagggcaggcagagctcatgaatgcctcttatcttcctaagcggagttttaggtgacacaggatgaagcagaagagatctacccatctcatctgctctgcacccagcttctaagtggacaaagccaagcccaggcatgagctctggcaaagcaagaccccagattctccatttttgcctgtggaaaggagggtccctttacaggcttttttttcctttttttcccccaaaatctcttaaaatgaggaatctcttagcagactttggagttccccattctgccacattctgaccatgagacgcggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtatggaaacctattacgatgcccttgagtcaagcactgagatacgttacccaattagggaaataaatttgttaataaaattgctgaggtc

SEQ ID NO: 14364 - DNA, 2822 bp, Homo sapiens
tgccagtccccaccagcccttccccagagggtcaggtgacccttccctccccaggccacggcagcccggccctcccgggcagacctcccgcaccagggctctggtgaacagcaaatgctccacgctgggacgggccattgcctgatgcctgtacatggtgggcactgagagacaagattcctgggccctgccttccatacactccccacgatctcggaggaagctctggctggctacctggtagacaatcgctgccaatccgtccaagtccaggggcaagggagtttccactgctgtgccacaggctgcactgaaggcccaggggtcttccctgctcacactgcgctctctgaggagaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgacttgaagcagccttgaagagtgagttcatgagctcatggtttttctccttgtatggactgctcgctccaagggcaggcagagctcatgaatgcctcttatcttcctaagcggagttttaggtgacacaggatgaagcagaagagatctacccatctcatctgctctgcacccagcttctaagtggacaaagccaagcccaggcatgagctctggcaaagcaagaccccagattctccatttttgcctgtggaaaggagggtccctttacaggcttttttttcctttttttcccccaaaatctcttaaaatgaggaatctcttagcagactttggagttccccattctgccacattctgaccatgagacgcggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtatggaaacctattacgatgcccttgagtcaagcactgagatacgttacccaattagggaaataaatttgttaataaaattgctgaggtcacc

SEQ ID NO: 14365 - DNA, 7199 bp, Homo sapiens
ggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttagtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 14366 - DNA, 6133 bp, Homo sapiens
gccgtcagggccccagggagcgcggggcgccgctgctgctgttcttcggctcggttctgtctaccgggcagcgccggggccggcggctgcggcggcagaggaacaggagccgggagccgcgttccgccgagagttgggcagaggagcgcccgcgccccggcggcgtcatgggccccctccccgcgcttcagagggcaccagccgcgggaacccccgggcctcctcgcgcccgagcctgagcgaccctcgggttctccggcgccccctccctcgccctattttttttcctactctcgctgccgttaccgcttctgctctccgttatggcaacagagccaccatcccccctccgggtcgaggcgccgggccccccagaaatgcggacctcaccggcgatcgagtccacccctgagggcaccccgcagccggcgggcggcagactccgcttcctcaacggctgcgtgcccctctcgcatcaggtggccgggcacatgtacgggaaggacaaagtgggtatactgcaacatccagatggcacagttttgaaacagttacaaccacctccaaggggcccaagagagctggaattctataatatggtttatgctgctgactgttttgatggtgttcttctagagctacgaaaatatttgccaaaatattatggcatctggtcacctcccactgcaccaaacgatttatacctaaaactggaagatgtgacccataaatttaataagccctgtataatggatgtaaagatagggcaaaaaagctatgatccttttgcctcatctgagaagattcagcaacaggtcagcaagtacccattaatggaagagattgggttcttggtgcttggcatgagggtttatcatgttcattccgatagctatgagacagaaaaccagcattacggaagaagcttaacaaaagaaactataaaggatggagtctccagattttttcataatgggtactgcttaagaaaagatgctgttgctgccagtattcagaagattgagaaaattctgcagtggtttgaaaaccagaagcagcttaatttttacgcaagttcattactctttgtttatgaaggttcatctcagccaaccactacaaaattgaatgacagaactttggcagaaaagtttttgtccaaaggacaactgtcagacacagaagtactagagtacaataataactttcatgtgttaagttccacagctaatggaaaaatagagtcttcagtgggcaaaagcttgtccaagatgtatgcgcgtcacaggaaaatatatacaaaaaagcatcacagtcagacttcattgaaagttgaaaatctggagcaagacaatgggtggaaaagcatgtcacaggaacatttaaatggaaatgtactttcccaactggaaaaagttttctaccatcttcccactggttgccaagagattgctgaagtagaagtgcgaatgatagattttgctcatgtgttccctagcaacacaatagatgagggatatgtttatgggctaaagcatttaatttctgtacttcgaagtattttagacaattgaatcctctgttgcagtctttttaaggggtgggccaatcataatgaagaggggcagtcaatatctgcacctttaatgctatgtaaaaaatttgtattatgagtcgacattttatttgtctttatacttttggaagaatggttaacttttttataatcttactcaggaaaactaactatttgttcattagaaaactatgaagaataaagaaacttaggaatgttaagcagggaatgtggtggtacatggcttaaacatcttttttggctcaagcaaaatgcaaaccattattcagtcattaagagtttagttagctttctgtagccaattcatgaaatctctgtccacccagccttgacaatgagccatatctaaaatattacattattagaacacctaccaaaatctcgaaagcacaggttgatgtccttagtattgctatgtatgaagttactaaaactggagaaaattctacttcagaaataagtactgtttaggttttatattaaaagttcagaccagcatatcaaagggtgctccttagtgaaatgatttagaattgttgcattccaaaagcaggttttctctttaatttttacatctctctctcaaaatattatacttcatgaaaaagacaattgatgtggatgacaacaacaaagtcttgaaattaagggcacactaattgtccttactggggttaggggaagagagatattattttcaaggaacaaaatattttcctttacaatctttcattcatgagaaaattggaatataaatttattacattgtgaaagtatcataaaccatatacctttgtatctaaatgcagcttcaaaaaagtaaataattgaagttttatttctcctctaaataacttgaatttttttctttaaaaatttatgtatttatatgtccccatttagttaagtggtagtgtaaatgtatgttgttaaaaacagtttctcagaattatagtaagcaatgaaagacaatatctaattaggttgttatcaaaaatactgtgtgtaaattagtccgtaatatagggtttggtgcgtatctatattcatgcttctatttcactcttcctcaaaacagttttatattatgttgaccagtgaaattgtaacttaatttcatggggacaggggcagtgctacagttcctggaaaaattagatttgtattatctttgtttcacacccaccaccttaaaaaaaaatcaactagttatttgtcatttaaaacatttaaaactttgagtcttcaaatacatttgatgttaatgctgccattacttgcacttccattcactaataacatttctaggtagttatcagttttgtcatattcctggaaaatattttggggttgtaaattctttctcctctttttcttctggagttacaaattgaatttttaaatccgagcacctttattgtggtgtggagaaaattatcacaattttatgtttattttaccttctcagccttctctgagggcactttgcaaatacctgagtccaaacagaagtaccaactaaatgctctatgaactctatccttagtaaatctattaaacctgaataatttaaaagatcatgttcattttgtaatagcaaaatttgattttaattttttatttagaattggtgtatttatcatagggacttccaatttttcttcactttttgaatggatattggctatagttttatgttttaacgggaatgaatttcaagtcataataatcagaatttttagttttacttttttcttttacaatatggattttgttgttatttggatagtggttcaataaatcttaagctcagataattaaacactattttgaatcttaacaagatactgaggctttttttgtatgggatgatatcaacctatgtacaatgaatttaataaacttaagtattgtcagattttttgcacattttagctcaataaaatcttaatgttcaagatttttttatctgcatttggaaatacaattttgtaaaatcaatgtcttacctttttgatacaatagatcatgttttgtttttaataaagcaagaagcccttttatctgttgtttttcagggaagggattaacatttaattctgtttgtttacatttgttatcattgttatccaatgctcattttatgttgctttataagtaggcttaggtataacagaataagtatctgtttatctaatctacatgtgactatcttagtctctctcggtcacttaatattatgctgaaatttaccactgtggggatgaatgatcgctattcaccaagtatatttgaacatgtaaatgcttaagaaataagcataatgcggatatagtttgggttaataggattctcatagttttttttcccctatgaaacataagtaatgattttagtgtatttcttatggaatacactcatttaaaaaggactttaagaaattgtggatgtgaataatacctttctctaataaaaatttaaattgtataatagttttataatatttacattaattgatattttaatatggatagacattgcatagattcaaataaattaaaatcaatgataaatgctaaatattttatctaaatagtttttcaagaaacagttatggaaatgtgtatattaaatggctctaatgtggagcttgtggtatttcaactcagtattcattattagttgtgtgtctggaaagattgtacttacttttcctctttacactacagtttgctcttatggggctctaaactgtttaactgaagaaccttcgtctgtattttgattgagcataatttagtattttatgatttccaagatgatgttcttatgtctatcaagtctatgtatcaaatttataacatcatttaagaaaaaggaatttccacagatacttcagttgcaattttttgtttcatgctactgaaaatacatttgtttctaggggttggaatattatagaagatgtaggatgaaagaaaacgatagaacaacgaaagaattctgtttatgaaattacaggaattgtgtccactatggtaaagcattgtcattttagtacattttctcttagtagtttggcattttatactttaaaacttgttttgctttaaaaattgtttataatgcttaccttctttctccagtgcctttagtcttgatttgatatgtttgtaccctcagttaccctttctattacatgtttttgatgttttcatagcctaggaaacatcgattcctttttaataattgtcaatctgattatttaaagaggtaacaattatctgttaatgctttggaaaaacaagtagggttgcctttggaggccaggcttcttagttcattcaaaaatattccttggatttatgccatgtattaagcatttttagcccccagtattacaactgtgaaccaaacggataaggccctaaccattttcagcattctctttggatggggtgggattggggacttaattaaaatagagatatagaaaaataggcatctaaataagataataagtgtggggttgaaatgaagcatctaacaatagttgaagttagaagtaatattttacagtattgtaacctctatttaagtttgggtattagttacagatagcataaaaaagccttaatttttcactttccttgctggcaaaggtacatttatttagactgtccatttaaagtaatgtttaacataaacattactgtgaaaaacattccattacatattcccaagcaaatgagctgcatcttctttactgtattttacaatttagtacaacagttttaggcctcaatcttaacatcactggtattttaaatttggcaatgaatatgaaattacttttgacttacagattgattatattattactttgaaaatgcattaatttcttagaaaagtttggagcctctatctttttttgagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttaaatataatttaacagtttgtaaagtgaaatagttttaagtatgatgtatgatgcacctgcatataaatgaaaatggcgtgcacaaagacactttactatgggaactgtactggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaatgtgtgatttgtgtttttattttatagaatcatctaatgtgatataccaatttttataagtgatatttacataattctaataactgtatatttgacaacctattaaaatgttttgcattggaa

SEQ ID NO: 14367 - DNA, 4733 bp, Homo sapiens
tgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 14368 - DNA, 550 bp, Homo sapiens
tgagacccccatcccatccactgaacaggagaccctttctcctctgagaactatttccctaccaaaggtggggaggccttctaagaccccaccagggacccccaccccacctcagcccagaggcagataacctgatccatcccgccctggttgccacaggtactatctcctctagggatggggcagaggtgctgggacaggtcagcaggacctccactgacttcttaacccctccccaaagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtc

SEQ ID NO: 14369 - DNA, 4656 bp, Homo sapiens
tttagacagctgtggaggccacaaaagagctccctgttgcttctcaggccctgccctgtggtgggtgtggagtctgtgtaggtctggtggggagacgggggtgttctggtcattcctgcccaataggcaacaccaggagggtggaagtggaccggccacatcattaaccctgtgcagcctgggcaggtggttttagggaaaccaagctgagggggttggggtgctgagcttgctggcaggaggaaggggtgctttgggtcttagaccccagcctgggggtgacagattctggccctgccttggcatcaggtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 14370 - DNA, 375 bp, Homo sapiens
atccccattttccagagcgggaagccgacgctcaaccccgcgccgcgacttgcccgaggtcacccagtgggccagcggctccgggaccgaggcgcggggcgggttgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtacc

SEQ ID NO: 14371 - DNA, 4733 bp, Homo sapiens; identical to SEQ ID NO: 14367

SEQ ID NO: 14372 - DNA, 275 bp, Homo sapiens
ccggagcagcccgggagttgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggc

SEQ ID NO: 14373 - DNA, 591 bp, Homo sapiens
ctggagcccagggccgctgtccggggaagggggcgccggagcagcccgggagttgaggccggcgctgcaggcagcggcggctgcgcggtgaacgaggcggcctgcgcgcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccgg

SEQ ID NO: 14374 - DNA, 1919 bp, Homo sapiens
ctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccagga

SEQ ID NO: 14375 - DNA, 2162 bp, Homo sapiens
gaatggaggaggaagatttaaaagtgaattcgtgggcggcgacaaggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccagg

SEQ ID NO: 14376 - DNA, 631 bp, Homo sapiens
agattactgcagcatttgtgctgaaactcaccagggttaaattgatgagctttctgcgtgaaagaagggagtggtggtgatttccggagcttgtagccaggctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatag

SEQ ID NO: 14377 - DNA, 613 bp, Homo sapiens
gcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacaggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggg

SEQ ID NO: 14378 - DNA, 840 bp, Homo sapiens
gtgagtcgatggcgccgggagggttcctcgcctctgcgcgccggcctgcgaggtccctgccccggcagcgaggccgcccccggccgggcccggccaggcatgcccggcatcgccgctgcagccagcgcggaggggagctcctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacacc

SEQ ID NO: 14379 - DNA, 552 bp, Homo sapiens
agccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctg

SEQ ID NO: 14380 - DNA, 812 bp, Homo sapiens
cgtttctcgagggaaaggctgctgcctcctgctctgtcctcatccccggcttagggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcag

SEQ ID NO: 14381 - DNA, 797 bp, Homo sapiens
gggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctctccgcgggtagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacat

SEQ ID NO: 14382 - DNA, 425 bp, Homo sapiens
gggcccggccaggcatgcccggcatcgccgctgcagccagcgcggaggggagctcaaattgcttaaaagataattatgttatataaagtgatcaatgaaaacaaacgtcatcttcattttttaaagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagc

SEQ ID NO: 14383 - DNA, 541 bp, Homo sapiens
gctgaaactcaccagggttaaattgatgagctttctgcgtgaaagaagggagtggtggtgatttccggagcttgtagccagggtgattagctcgcctgagtgttattagggtgttataaggagtgtttcttggttattcaacagtgtagttagtatcgtttcttttaagaaaaaaaattgattttaacacttgaataaaagaaacactgctgatattgtttatcttgaaagctttcaaatcggactccttgagatcttcacgctactgttaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaag

SEQ ID NO: 14384 - DNA, 626 bp, Homo sapiens
tgtcctcatccccggcttaggtaacacgttttcctccttacgacacccaccacagggtccccgcgccgctgcccctcctccttggatctggggcccgggctggtgagcggcgcgcgccgtcgcctctccgcggctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgtt

SEQ ID NO: 14385 - DNA, 2040 bp, Homo sapiens
aaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttaggtcacactctgtcatccaggctggagtacagtggtgtgatcatggcttatgcagtctccacctctcaggctcaaggaatcctcccaccccagcctcccgagtgtctgggactacaggcacgtgccaccatcccagctaatttttaaaattgtagagatggggtcccactatgttgcccagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaat

SEQ ID NO: 14386 - DNA, 6752 bp, Homo sapiens
gtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgtttaactcttggagtttttagtattaccaaactcctagaaatttaagctaccaccaaaaataacatgtgccttttccctttattctcattgatggtagcagtgcacctcgtttcagtgtcctgattccttgattactgtgaacactgaacatcttttatacctttatgatatttctatgtttgtgacttcattggaatgttgatctatttcatatagattgtttttaatatacaatgtattagcccctgtca

SEQ ID NO: 14387 - DNA, 6406 bp, Homo sapiens
cggcgtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgtttaactcttggagttttt

SEQ ID NO: 14388 - DNA, 3231 bp, Homo sapiens
gaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagcattggaacacgggaggtagtcacccagaagaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaacatgtccagccaccg

SEQ ID NO: 14389 - DNA, 3365 bp, Homo sapiens
gtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacatacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctag

SEQ ID NO: 14390 - DNA, 2934 bp, Homo sapiens
atgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtga

SEQ ID NO: 14391 - DNA, 6635 bp, Homo sapiens
gtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacaacaggaagaatctcgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgtttaactcttggagtttttagtattaccaaactcctagaaatttaagctaccaccaaaaataacatgtgccttttccctttattctcattgatggtagcagtgcacctcgtttcagtgtcctgattccttgattactgtgaacactgaacatcttttatacctttatgatatttctatgtttgtgacttcattggaatgttgatctatttcatatagattgtttttaatatacaatgtattagcccctgtca

SEQ ID NO: 14392 - DNA, 3347 bp, Homo sapiens
agagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagctagaaagagggatgccccagcccctagacctctccctgcttctgaggggcatctccagcctccagctcagacatctggtcctacaggctccccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 14393 - DNA, 2393 bp, Homo sapiens
aggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 14394 - DNA, 2215 bp, Homo sapiens
aggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 14395 - DNA, 2515 bp, Homo sapiens
aggctgccgggggctgcagacatggagggccagagcagcaggggcagcaggaggccagggacccgggctggcctgggttccctgcccatgccccagggtgttgcccaaactggggcaccctccaagacagagaaactgaggcgctgggcagagaggtacttgcctaaggtcacacagagctgggctttgaatctacacagccagtctcagctcccagctcttgctcctgagtggagctctgggaatgggtggactcaagttttcagctcccagcaaagaagaacgcagccctaggaccctcggaaccaagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 14396 - DNA, 3212 bp, Homo sapiens
agagctggagccggagccaagggagtccaggctgccgggggctgcagacatggagggccagagcagcaggggcagcaggaggccagggacccgggctggcctgggttccctgcccatgccccagggtgttgcccaaactggggcaccctccaagacagagaaactgaggcgctgggcagagaggtacttgcctaaggtcacacagagctgggctttgaatctacacagccagtctcagctcccagctcttgctcctgagtggagctctgggaatgggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagctagaaagagggatgccccagcccctagacctctccctgcttctgaggggcatctccagcctccagctcagacatctggtcctacaggctccccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatggg

SEQ ID NO: 14397 - DNA, 4728 bp, Homo sapiens
atggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatgggcagatgctgagaactgttcctgggatagggaaagtcaaggaggaggaccatgttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactc

SEQ ID NO: 14398 - DNA, 3628 bp, Homo sapiens
aagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 14399 - DNA, 1174 bp, Homo sapiens
ctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatgg

SEQ ID NO: 14400 - DNA, 3622 bp, Homo sapiens
aagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttct

SEQ ID NO: 14401 - DNA, 3628 bp, Homo sapiens; identical to SEQ ID NO: 14398

SEQ ID NO: 14402 - DNA, 4020 bp, Homo sapiens
cgacctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactc

SEQ ID NO: 14403 - DNA, 792 bp, Homo sapiens
gtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatgg

SEQ ID NO: 14404 - DNA, 4021 bp, Homo sapiens
cctcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 14405 - DNA, 2180 bp, Homo sapiens
atggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatgggtattgtttggaggtcttgttatcatatcctctttccctcctctcccaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacatt

SEQ ID NO: 14406 - DNA, 832 bp, Homo sapiens
gcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgg

SEQ ID NO: 14407 - DNA, 1432 bp, Homo sapiens
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgggtgagtgtgtgctgccccagccctgggcacagagggatgtggagcgctgggtctggtctggcccagccctggtgacagggccccaggggtggggg

SEQ ID NO: 14408 - DNA, 2962 bp, Homo sapiens
ggaactttcccagcggatctaatggctgcgcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtga

SEQ ID NO: 14409 - DNA, 806 bp, Homo sapiens
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagcggcatgttccacacacctcattggaggctctactgattttgcatgaggacccccagctgcctgacccccacctgccactctga

SEQ ID NO: 14410 - DNA, 2767 bp, Homo sapiens
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaata

SEQ ID NO: 14411 - DNA, 416 bp, Homo sapiens
gtcacggccaacgtgggctcgctcttcgacgacccagaaaacctgcagaagaactggcttcgggaattttaccaggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacag

SEQ ID NO: 14412 - DNA, 2929 bp, Homo sapiens
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgctacttccccgagtgcaaatggtcaagaaaaggcttcatccggacgaggtgattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaata

SEQ ID NO: 14413 - DNA, 610 bp, Homo sapiens
ctggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagg

SEQ ID NO: 14414 - DNA, 594 bp, Homo sapiens
gcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagcggcatgttccacacacctcattggaggctctactgattttgcatgaggacccccagctgcctgacccccacctgccactctgacccttttggttcacggcgatgcattcggagcattgtcactgttccctg

SEQ ID NO: 14415 - DNA, 2749 bp, Homo sapiens
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaata

SEQ ID NO: 14416 - DNA, 3394 bp, Homo sapiens
gccgggctgactccgcttctgggcggccgggcctccgcgagtaccgggtcgacttcggagtctgcgagcccagccaggggtgcccgcttcccacccctctccccgagcggcgtccccgtcggggtcgaacctcccccgcgacaggcgcccagccgcctgttcccccaggccttgcctgcggaccgccctgggaacggcgtctgggagccccgaggggctggcgggactcggggcccgggccatgcggcagccgcccccgcccctccgcgaccatccccggcccaagcgggagccgcagcggcgtttctgctcctcgctgcgccggcgaccccggacccggcacccgtgacccctcgcgctgcctgcggcctcgcgccgaggcctgccccgggagagaccgtccatgccgtccaaggcggagaatctgcggccctccgagccggccccgcagccgccggaagggaggacgctccaaggacagcttcccggcgctccgccggcccagcgcgcggggtccccacccgatgctccgggctccgagagccccgcgcttgcctgcagcactccggccacgcccagcggcgaggacccgccagcccgagcagcacccatcgccccgcggccccccgccaggcctcgactggagcgagccctgtccctggacgacaagggctggaggaggaggcgttttcgaggcagccaggaggacctggaagcccggaatgggaccagtccctccaggggctcagtgcagagcgagggccccggggcccccgcccacagctgctccccgccctgcctgagcacctccttgcaggaaatccccaagtcccgcggggtcctgagcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacaggcgggagtgggagactcgtctgcaggagacgctgggcccgcactatgtgctgctgtcctcggcggcccacggcgtgctctacatgtcgctcttcatccgcagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 14417 - DNA, 3934 bp, Homo sapiens
ggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggttcggcgggcggcgggaagctgggctggggagctgggccgggggcggcggtgcgcccggccctcgggtgggcagggtcggcggtttggccagtggacgctcggggcgaagaccaaagtcctggtggccctctggaggctgggacactggggcagaagttctgtgatgttcttcttaggcgtgcgtgacgagggtaggcgggtgggaatggggtacttgggaatccggaggctggggttttagtaaagctccgttccgaactcgctgtgtgacctcgggccactcgctgcccctctctgggcctgttgctccatctgagcttgctcttcaatcctgatcttccgagtttgtcgcgtggggcgggtgggggagtggtgccctgcctacgatagagtcttcctttgggtgaggtatggtatgtgttggggctctgtcagttctcagcccctgtgatgatagcgcagtgtacagggctggagtcttggggagccctgtctactctgggactagaggccaggatgaagttacaggttataaaaggactaggttttttcccacccagcagttggtggataatggggagcacagaaggccagttgctgagcaggagcttgtcgtttggagatgggaggctcagggctgaaatttgggtgagtccgtgctctgggaggacctgcagacctgtctttttttgtccagctccagggttttctgcaagggcccctggtgcttttttcccctgggtgtgtccgtgaggctccatttatgtgtgagctttggcatgacccctagtacctatttgtgacagtcatttgccagcaatgaagagcctgtcaagtagctgtgtaaagtgtgggccagccctccacttgctcttacaaggcttggaaactatgaggggcagggaggagtggcatgttgcacaagagtttgtaaactgagaggaaacgaggtgagcagaggacttcctcggtgcttgtttctccttcattgcagccatcacaaggtgcgatcgaagcgcctgatggtgctgatagtttgcatcttccttgggcttatctcagagttcactatcactagagtttccatgacattctgggctatggtgctgggacgggtgagagtttaagagcacctcatctccttgccccttcacaagagactgccagaatccagacaattggcggaggacaaggccaatggcagcagaaagaggtgggtgctgtgttctcagccagtacaccagagccaggccatgcaggcacttcattcccttagtcttctatgacaagtcaggccagctagctctgaagccagttagctgccccgactgagaaatgtgcagggatctcaatctttcatttcctttcaaaaaacagagactagccatatgctggtgaggaattattgttacggtttcggttttatttttattttaaaataatttgaaagctgaacatggtggcgcgtacctgtagtcccagccacttgagaggctgaggtggaaggcttgagcccaggagtttgagggtgatgtgcactatgattgatcctgtgaattagttgctgcactccagcctaggcaacatagtgagactgtctctaaaataaataaataaatagttttaaaaattttgtcagccaggcgtggtgactcatgcctgtaatcccagcactgtgggaagctgaggcgggcggatcacctgaggtcaggagttcgagaccagcctggccaacatggcgaaactccgtcactactaaaaatacaaaaattagatgggcgtggtggcaggtgcctgtaatcccatgtactctggaggctgaggtaggagaattgcttgaacccaggaggcagaggttgcagtgagccgagatcgtgccattgcattccagcctgggagacggagcaagactccatctcgaaaaaaaaaaaaatttttctcttaaaatacctacagtaagtggggtgacactattaattgctaagttgctcctgctaaaattggtaagaaatggtatcaagcccctcagttctatttgggtcatctgtttccagagttattatggcctcagaggagagttacatcttctataacaggtaggaagaaccctttgggctgcctttggatgtcgatacaggccccaagggaaacagagtagtagattgttttttcctatatgcatatgatcaaaatacccactttttgatagcctagagaacccaaagcaaacagttgcttaaaaatgctgtttctggctgggcacgatgactcatgcctttaatcccaacactttggaaggctgaggcgggcggatcatgaggtcaggagttcgagaccagcctggccaacatggcgaaaccctgtctctactaaaaatacaaaaattagatgggtgtagtggcacatggctataatcccaggtacttgggaagctgaggtaggagaatcgcttgaacccaggaggcagaggttgcagtgcgctgagatcgtgccactgcactccagcctgggagacagagcgagactccatctcaaaaaaaaaaaaatttttttttatcttatcgtaatacctacagtaagtgactgggtgacactgttaattgctaagttgctgctgctaaaattggtaagaaatggtatcaagctctccagttctgtttgggtcatctctgtttccagagttgttctggcctcagaggagagttacatcttctataacaggtgggaagaaccctttgggctgcctctggatgtcgatacaggccccaagggaaacggagtagtagatttgttttttcctatatgcatatgatcaaaatacccactacttgatagcctagagaaaccaaggcaaatggttgcttaaaaatgctgtttttggctgggcgcggtggctcatgcctaatcctagcactttgggaggccgaggtgggcggatcacaagatcaggagttcaagaccaggctgggcaacatgacgaaatcctgtctctactaaaaatataaaaattaggccaggcacagtggcttatgcctgtaatcccagcactttgggaggctgaggcaggcggatcacaaggtcaggagatcaagaccatcctggctaacacggtgaaaccccatctctactaaaaa

SEQ ID NO: 14418 - DNA, 4694 bp, Homo sapiens
aaatgtagtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 14419 - DNA, 3060 bp, Homo sapiens
agtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaa

SEQ ID NO: 14420 - DNA, 3230 bp, Homo sapiens
catggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacac

SEQ ID NO: 14421 - DNA, 3905 bp, Homo sapiens
gcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 14422 - DNA, 4255 bp, Homo sapiens
aaatgtagtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 14423 - DNA, 1241 bp, Homo sapiens
cacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgtgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccaggatacatgttatcccttggtgggcccgaattgctcttgctgcctcagatgacttagccacatggacatgaaggccctgattcatcactccccacctgagccagggcactcgccaggcagcgggcactgctgtttctgtgagtacttccagtgtggactttgcatttcagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggctt

SEQ ID NO: 14424 - DNA, 2690 bp, Homo sapiens
gttagcacctaaaagctgcataatcggaatcatatctgcaatctgggttttgtcaaaatagtactatagaataaatgggagaaagaagaaagcaagctaaatgggaaaccgtgaatgaatggaggacgaaagaagaaaaaggcaaagtaaagagagaagtaatgtttaaaaactgagagatgaaaagacaagcaggagaaaagaaccagaagctagaatgaagaggcagtatcccatgctccagcgcgggtcaggacccggcccggcctggcagaggctcgcagggcgcagctcggggcggggcccagcaaagcaaccacgccccctcaggaatggagtttttaagggcggaacttcctgttgcgagtagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactt

SEQ ID NO: 14425 - DNA, 1106 bp, Homo sapiens
gagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaaggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggt

SEQ ID NO: 14426 - DNA, 1180 bp, Homo sapiens
cacagagctagccggacgtcctccgactcaagctcctagaaacttggtgcatccccaggcccaggtagtcactctaagtgatggggcagcgcccaggtcctgtgctgcccgcagtcgcggtgctgggacaggtggcaaaaaggaaggtggcctggctcctacgctggaaggctgtgaccaggacagaaacagcaggaaacagttcaggtgtttatggctttgggaaaatgaaaatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgctt

SEQ ID NO: 14427 - DNA, 543 bp, Homo sapiens
ggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatg

SEQ ID NO: 14428 - DNA, 770 bp, Homo sapiens
gtagcggttcgctcacgcgacctcacttaacctctgtggcggcttctgtggaataattgcccctttttatgtccccaactccgaaaagctcctagaaacttggtgcatccccaggcccaggtagtcactctaagtgatggggcagcgcccaggtcctgtgctgcccgcagtcgcggtgctgggacaggtggcaaaaaggaaggtggcctggctcctacgctggaaggctgtgaccaggacagaaacagcaggaaacagttcaggtgtttatggctttgggaaaatgaaaatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaag

SEQ ID NO: 14429 - DNA, 1528 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 14430 - DNA, 1574 bp, Homo sapiens
cgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggtctcctttttctctagtacacatgtgaacccggcacaggaactggatagaaaacctctcggcaaggccacatagtcatgcacagaacagatgtttgcttagcgcctgcccaaggcctcacccttagtgaacttgggacagtccaagagtgtcaaaagcactgccctgaatgctttagatctagtcttttctttgatcctgagaatgcctttggaaggtgtaaacagcggccagctccacagggaccagcctgcagaaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacaggatctcactctgtcacccaggctggagtgcggtggtgcagtcttggctcactgcagcctccacatcctaggttcaagcaattctcctgcctcatcctcctgagtagctgggactacaggcatgcgccaccacatctggctaatttttttgtattttttagtagagacggggtttcaccatgttggccaggctggtctcaaactgctgacctcaagtgagccttttgcctcggcctccgaaagtgctggggttacagttgtgagccactgcacctgaccatatttttaaaatatagagtcgataatgagttatactgggtttttttttttctgtttttttttttctgagatggagtttcactcttgttgcccaggctggagtgcaatggggcgatctcggctcactgcaacctccgcctccctggttcaagtgattttcctcctaagcctcccaagtagctgggattacaggcgcatgccaccatgcccagctaatttttgtatttttagtggagacagggttttgtcatgttggccaggctggtcttgaactcctgacctcaggtgatccacccgcccgggcctcccaaagtattgggattacaggcatgagccaccacacccggcctcaaccccatctcttaaaaaaataaaaagataacctttgctctc

SEQ ID NO: 14431 - DNA, 1647 bp, Homo sapiens
ccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatgctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactc

SEQ ID NO: 14432 - DNA, 2420 bp, Homo sapiens
acttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 14433 - DNA, 2258 bp, Homo sapiens
acttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 14434 - DNA, 2039 bp, Homo sapiens
ctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 14435 - DNA, 1838 bp, Homo sapiens
gccgagccgctccagtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctgaggcggtatctgaaccgcctgcagcagatccgggacaccctggaggtatccgagttcttcaggaggcacgaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaaga

SEQ ID NO: 14436 - DNA, 5822 bp, Homo sapiens
atggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 14437 - DNA, 3146 bp, Homo sapiens
attgaacaaacactgaagtagcccggagcagacactgacaggggcagtatctccacggtcgaaaagggcgtgcagggccggcttggcgtcgccactgccgggatcgccgggcccctgaaccgaagagctttcccccctctttcgcactcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgtgacttcttgggaagtgttcccctcagtggtactgctggggcaacgtccaataccaagaatgatgtatagcatatttcatcttcctacactactctctggaaagactgagccaattacggggtcatctgtaaagtctaagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaa

SEQ ID NO: 14438 - DNA, 6150 bp, Homo sapiens
cttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 14439 - DNA, 3383 bp, Homo sapiens
gggtcggccgaagcccgaaccgaaggagcgggcatgaggcgctgcccgtgccgtgggagcctgaacgaggcggaggccggggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagcc

SEQ ID NO: 14440 - DNA, 2954 bp, Homo sapiens
ggcctctgtaaggagacttggagtcgctgcagccaaggctggagccatgagacggccccctggcaatggagaggcggccagcgaaggtccaggtggctggggtctatggggagtccaggagtccaggaggctgtgctgtgccggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 14441 - DNA, 2878 bp, Homo sapiens
tctggagctccagctgcgccccgccaccactggccgctcgcactaccagcctgtctcgcacgctaaggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 14442 - DNA, 2981 bp, Homo sapiens
tctggagctccagctgcgccccgccaccactggccgctcgcactaccagcctgtctcgcacgctaaggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggtggagtctcactctgtcaccaggctggagtgcagtggtgcaatctcggctcaatgcaacctccgcctcctgggttcaagtgattcccctgcctcagcctcccaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattccc

SEQ ID NO: 14443 - DNA, 2750 bp, Homo sapiens
tctggagctccagctgcgccccgccaccactggccgctcgcactaccagcctgtctcgcacgctaaggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattccc

SEQ ID NO: 14444 - DNA, 1576 bp, Homo sapiens
ccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 14445 - DNA, 1702 bp, Homo sapiens
ccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 14446 - DNA, 3010 bp, Homo sapiens
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaa

SEQ ID NO: 14447 - DNA, 2623 bp, Homo sapiens
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacc

SEQ ID NO: 14448 - DNA, 596 bp, Homo sapiens
atgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatctttt

SEQ ID NO: 14449 - DNA, 1127 bp, Homo sapiens
gggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaa

SEQ ID NO: 14450 - DNA, 2590 bp, Homo sapiens
gtgggagtggaggaggaagaggcggtagggggtacgggggctggtcccagaagatggcggaggcgggggatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccatatatttcatctgtcactagccagagtgtgaacttgatgattcgaggagtagtgctattttttattggagtatttcttgcattagtgttaaatttacttcagattcagagaaatgtgacgctctttccacctgatgtgattgcaagcatcttttcttctgcatggtgggtacccccatgctgtggcacggcttcagctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttctcatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggt

SEQ ID NO: 14451 - DNA, 9059 bp, Homo sapiens
gagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 14452 - DNA, 9023 bp, Homo sapiens
gagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 14453 - DNA, 637 bp, Homo sapiens
cccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggcgagtccagtcatcagctccgctgtaagctgttggccctgcattcaagtaaccagaaccacccgtgagagctgccaccagtaatgtcactcgaagcttccttttttttttttttaattccgaaagtctaaatctgtaattaccaagggaccatttaaacatggttttatttgtaattgtcacaaagttaatatcattaaaaggaaactcactaagg

SEQ ID NO: 14454 - DNA, 6999 bp, Homo sapiens
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagagtatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgttttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaacaaaaagaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaa

SEQ ID NO: 14455 - DNA, 5101 bp, Homo sapiens
cccccgctgccctccttgggagcggtccccagcctgctgctccgccctcagggttggctggcctctcggcctgccttttgctcagaaccctgtgtcattttctccctctggaggcccgagactctccctgtcactgtctgcatctctgtccccatctctcaatctcatgctgagtctctctgtctccaactgcctgtcactgtctttgtgtctctgtgactctcatttctttttttctgtctcctgctgtctctgtgtgggattccttgtctctctgcccctgccctccctctcctatctgaaccctggtctctgtgtcccttagggcttatcacaccgttctccccagagtcaccgggaggagagccgggactggacacaagccagggctgggacaatggcagtgcctagtctgtggccctggggagcatgcctgcctgtgatcttcctctccttgggatttggcctggatacagtagaggtgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactgaggggcacctcattccctggctggcctcccatggggagacaggaagggacccgacctctgtggctgagacgcctgaatgttcacccccaccccaactcagggcaagggatggccgagggtggggcagagaacaggagcagggaaggctgtgggggtgggcagaggggtctcaccataggagtttctcagactctgagtccctcgggggagagcaagcagggtcaaagccagaggagtagagatcaggtcagggagagatgtcctgccctcagaggtagggaccccactcagactaggaagagggggcccgcccaccctagaggccctgcccctcagtttggggtctcctctggacaggtagggccagcgacatgtttgaaatcagatgagcaatcagaagcaggcctggggcgctctccatgcatgtatgggaggggggtggggctccacatgactgccttgcttgccactggtttcacctcctcccctcagctccactgaccaggtggcatggggagaacccaggggcctggggagtggttcccagcctgcccgccctcacctcctcctctccttttgccctgcccagggctccccaagcttggtgctccttcctccttttctccaggggcatcccttggagtacagtcaccctttcttcagtccctcccctcaatgattagccctggatgcttaaggctttcagagcctcatcttcctccctcccctcaccctcacccagccccgcccccacccctgcctctcatgggaagactggagaaggcacaataaatgctgaggcctgtttgta

SEQ ID NO: 14456 - DNA, 5877 bp, Homo sapiens
ccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacctctcaacatcccagtttgaccagatttcttgctttcattgttcataatgcagaaagcagtgaattatattaacattttaaaagtgtttctgggtaacaatgatttttgtcaaatagaagactcaatttcacaaccttaagaatagatcacttttgtaaaacaagaatctcagtatttgatgttggactccttgctgtgagtattgtcactgactccaaacccagaaagatttgttcctgcccttacagggatgaaaataaaaaggatagaaaaaatatttctctcctctacaatgagtccttacatcttcttgccacatctccagctgcagtttaggcagatatcttgttcaatctctgtcttcttgatccctgtcaaaataatttttctactcatatagtggccagttggctcaggcaggcatttcaagaggaatctgcttgttcctcacttttccagcataggacagtggtccagcccgcacagtcagc

SEQ ID NO: 14457 - DNA, 4480 bp, Homo sapiens
agttgtaactgtagtaggtcagtgatacatggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacctctcaacatcccagtttgaccagatttcttgctttcattgttcataatgcagaaagcagtgaattatattaacattttaaaagtgtttctgggtaacaatgatttttgtcaaatagaagactcaatttcacaaccttaagaatagatcacttttgtaaaacaagaatctcagtatttgatgttggactccttgctgtgagtattgtcactgactccaaacccagaaagatttgttcctgcccttacagggatgaaaataaaaaggatagaaaaaatatttctctcctctacaatgagtccttacatcttcttgccacatctccagctgcagtttaggcagatatcttgttcaatctctgtcttcttgatccctgtcaaaataatttttctactcatatagtggccagttggctcaggcaggcatttcaagaggaatctgcttgttcctcacttttccagcataggacagtggtccagcccgcacagtcagc

SEQ ID NO: 14458 - DNA, 772 bp, Homo sapiens
gaattcatcatcagaggaggaagagttcccagtcattgtcttcacttctccagaagtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtgg

SEQ ID NO: 14459 - DNA, 740 bp, Homo sapiens
ccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcgaccgtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagc

SEQ ID NO: 14460 - DNA, 898 bp, Homo sapiens
cccccagctgggacggcccaggcgcctataaagggggtccccgcttggccccggcgccacccaccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcgaccagagggagtctcactctgtttcccaggctggtctcaaactcctgagctcaagtaatcctcccaccttgaccttccaaagtgttgggattagcgatgtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagc

SEQ ID NO: 14461 - DNA, 1952 bp, Homo sapiens
agtctggagcccagaagggacacaccagcacagtctggtaggctacagcagcaagtctctaaagaaaggctgagaacacccagaacaggagagttcaggtccaggatggccagcctgttccggtcctatctgccagcaatctggctgctgctgagccaactccttagagaaagcctagcagcagagctgaggggatgtggtccccgatttggaaaacacttgctgtcatattgccccatgcctgagaagacattcaccaccaccccaggagggtggctgctggaatctggacgtcccaaagaaatggtgtcaacctccaacaacaaagatggacaagccttaggtacgacatcagaattcattcctaatttgtcaccagagctgaagaaaccactgtctgaagggcagccatcattgaagaaaataatactttcccgcaaaaagagaagtggacgtcacagatttgatccattctgttgtgaagtaatttgtgacgatggaacttcagttaaattatgtacatagtagagtaatcatggactggacatctcatccattctcatatgtattctcaatgacaaattcactgatgcccaattaaatgattgctgtttattagaacatgagaatcattattagtattcacatgtttcacttgctctgtactaatatagtctctccaaatggaggaagttagatagatggaataagttctagtagttgatagtacaatggggaaattatacttaacaataattcactgtatattccaaaatagctagaagagaattgtaatgattccaacacaaaaaagatgaatgttagtttggatgcatatcccaattaccctgatttgatcattacacattatatacacgtatcaaaatatcacatgtactacaaaaatgtgtataactgtaatatgtgaactacaaacttactggaaataaatttttaaagttttacacacataaacacatacgttcacacacactcactcaagtctcttcatttttcctcttttcacactagaagaaatgtaagagataaaggatctaaccatctctaacatcagctcatagtacggaggaaaagcagtgaaggaatgaactggtgggagaggtattaggcatgttcaccctagggtaaacccagagacctccctagaactttgcccaatgcatatcctccacctgcctctcagcacgctgcctttagaccttcaatcattctataaactcctcttttgtccctggcattactccacatcccctcatcaaagtggtgaattggcacaaatactggcattcctctggctacacatacctcctccctatgtgtctctaaatcctaaatcaaagagtacattttatactctgtcagtgaggttctactagttgtgtttgtttgtttgcaggctaactgaagctgctactacctcattatcaggtcctataaacttaattcaagtggcatgatttgagtagccccctgtgcctgcccataaagtgctctgaatctagtgtgggacatggagaagcaaaggataataagtgcaatgatacttgtaggtcatcatagagactgtaatgatccacaggaatcagggtcgtgtttaatgccaacatgtgaaagaataaatatacagggaacagtgtaggtaagaggagagagcaaaatttccctaaggaaactgatggctgatctgcatcttgaaagacatctaagcagaagagagtgcaaaaagggacaagtagaagcccaggaaaatgcacaaaggcctggaagcatagcatgtgtggaaacagccagagtcagcagggcaggaggtggtgtggagaaaaggaattgtcaagatctggttggaatggagacaggagagaggatctcaaacgattccacacaatgcagctatggggtttaggctgcatcctggagtaaggaagaactgc

SEQ ID NO: 14462 - DNA, 715 bp, Homo sapiens
ttaccatatcagattcacattcagtcctcagcaaaatgaagggctccattttcactctgtttttattctctgtcctatttgccatctcagaagtgcggagcaaggagtctgtgagactctgtgggctagaatacatacggacagtcatctatatctgtgctagctccaggtggagaaggcatcaggaggggatccctcaagctcagcaagctgagacaggaaactccttccagctcccacataaacgtgagttttctgaggaaaatccagcgcaaaaccttccgaaggtggatgcctcaggggaagaccgtctttggggtggacagatgcccactgaagagctttggaagtcaaagaagcattcagtgatgtcaagacaagatttacaaactttgtgttgcactgatggctgttccatgactgatttgagtgctctttgctaagacaagagcaaatacccaatgggtggcagagctttatcacatgtttaattacagtgttttactgcctggtagaacactaatattgtgttattaaaatgatggcttttgggtaggcaaaacttcttttctaaaaggtatagctgagcggttgaaaccacagtgatctctattttctccctttgccaaggttaatgaactgttcttttcaaattctactaatgctttgaaatttcaaatgctgcgcaaaattgcaataaaaatgctataaacca

SEQ ID NO: 14463 - DNA, 758 bp, Homo sapiens
agacagggagcagggtccggccgaccgccattgcacaacgcggaggactagcctggggtcacagggatgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttggtaagacaagagaattttcttcatcacataatatcaatgtatatattcatgagaatgcaaaatttcagaagaaacgtagaaacaaaattaaaaccttaagcaatttgttttgggggcatcatccccaaagaaaacgcagaggatattcagaaaagtgttgtcttacaggatgtacaaaagaagaacttagcattgcatgtcttccatatattgattttaaaaggctaaaggaaaaaagatcatcacttgtaactaagatatactaaccatcttagaattttttctaacctaataaaagcttaatacatttatttaa

SEQ ID NO: 14464 - DNA, 8274 bp, Homo sapiens
atttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaagccatcatgaagctgaatggccaccagttggagaaccatgccctgaaggtctcctacatccccgatgagcagatagcacagggacctgagaatgggcgccgagggggctttggctctcggggtcagccccgccagggctcacctgtggcagcgggggccccagccaagcagcagcaagtggacatcccccttcggctcctggtgcccacccagtatgtgggtgccattattggcaaggagggggccaccatccgcaacatcacaaaacagacccagtccaagatagacgtgcataggaaggagaacgcaggtgcagctgaaaaagccatcagtgtgcactccacccctgagggctgctcctccgcttgtaagatgatcttggagattatgcataaagaggctaaggacaccaaaacggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctagaggcaggggttgtggggcactcccagccacggcactgttaccttggtggtgggacttggaacccaaccctgagctcccgataaagctaaagtccatcatctggcaaattcagtaaattggagagtacttgcttctgtttgtatctgagaggaatttttaactgacggcttctgtctccatgaatcattatcagcatgatgaaaggtgtgtctaaaaaacaattcagaataccagcagcattgtacagcaaggggtaaataagcttaatttattaatttaccaggcttaattaagatcccatggagtgtttagcccttgtgggagacagaagccatcagttaaatgaggttaggcctctcctcctaatatactgattgacaatgcatattagccaggtaatgcactttagctaccctggacaatgctatcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccatgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactgggcgatcccagcccctccccacccaccctctaatggacctcctcatagaagccccatttcacttttgttttatctacctcttagcaaaacaatagataaattaggtagtggcagctccacttgcttaggttagggggggaaaaagatttctttttccaaaggaaaaaaatattaccttgagaatactttccaaaaaataaaattaaaaaaaaaaaaaccaaaaaaaaaaatttttttttaaaagggagacattttccagtgaccactggattgttttaatttcccaagcttttttttcccccataaataagtttcactctttggcgattttcttcacttgtttaagataacgtgctagctattccaacaggtaacagctttcacagtctgcccctggcctgtctcaccccatcccccaccctattcctgccagtgagtccttcctgtgcttctctcccttctcccctcccagccagctgacttcagtcacccctgtcccccctcccctgccaataagctcccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcaccatt

SEQ ID NO: 14465 - DNA, 1317 bp, Homo sapiens
atgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtga

SEQ ID NO: 14466 - DNA, 3291 bp, Homo sapiens
cggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaa

SEQ ID NO: 14467 - DNA, 3688 bp, Homo sapiens
ggggggcggaggaggaggagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaaga

SEQ ID NO: 14468 - DNA, 3358 bp, Homo sapiens
atgttctcatgtcctggacactaccacgttgatggctttctaaatccagggagcaggaaaattcagattcgaaacatccctcctcacctgcagtgggaggtgttggatggacttttggctcaatatgggacagtggagaatgtggaacaagtttttgccttttccctagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtg

SEQ ID NO: 14469 - DNA, 4250 bp, Homo sapiens
ggccgaagccaaaggggttgggaaggaagagacaaaaagtagttttttcccctcctcctcctcctttctcttgctaatcccgcctcctcctaagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 14470 - DNA, 9091 bp, Homo sapiens
cgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccaggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctcgtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaa

SEQ ID NO: 14471 - DNA, 1653 bp, Homo sapiens
ttgggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgtta

SEQ ID NO: 14472 - DNA, 2200 bp, Homo sapiens
cccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgat

SEQ ID NO: 14473 - DNA, 1187 bp, Homo sapiens
agccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagagga

SEQ ID NO: 14474 - DNA, 1427 bp, Homo sapiens
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaacacagtacatatttgtcatttttaaaaagccacacaatagaaacaagacaccaagatatttaattatcttgttgactcctgtaaaatagctaaacactcatcattcgcggtgcaatactcatagacataagttcctgaaacaatagtttgcatgcgtaaggcattcgcaccaaagaaatctgaaaagaaaaaacaaatggtaattagcagaattgtattgaagtgaccccacttctctaccccagaaaaagacaaagatctggtactgtagataatgaataaatgagtggagctgagaacacaca

SEQ ID NO: 14475 - DNA, 1251 bp, Homo sapiens
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtacacaataaatctcacagccatttaaaaatgactagtacatttgctttaaaaagaacagaactaagtatgaaagtatcagacgtagctattgatgaaattctgtagttagcaacccataagggcattaagtatgccattaaaatgtacagcatgagactccaaaagattatctggatgggtgactgaacatcgttattatgacttagatgcttttaccttatctaacatgtaagagtcaaaatcaaacttgcctggaatggcttctatttcccatagctttctacctatctacttggcattttccctttgtgttgtgactattaaattcctatttaaaagaaaatgattgtgggcaattctcgcccttcacttttgcttttaaaag

SEQ ID NO: 14476 - DNA, 2086 bp, Homo sapiens
ggaaatccagagggcaggggtggccggcacagcagacgtaccctccctcgctgcctgcctgcagcctgccctgcatgcaggatggccctgaggaaaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatctaa

SEQ ID NO: 14477 - DNA, 2198 bp, Homo sapiens
ggaaatccagagggcaggggtggccggcacagcagacgtaccctccctcgctgcctgcctgcagcctgccctgcatgcaggatggccctgaggaaagcgggtgacctcgagcctcagttcacacctgagcgccgcttccggctgtgctggtatcaggctcactcgggcagagccctcctcgggccgcctccccaagcctctccccccgcaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatct

SEQ ID NO: 14478 - DNA, 2826 bp, Homo sapiens
gggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcctccccttggcggggagaagctttttttcttgctagtattcgctgtgttcatggtctagaaatgcggtctggtctcgcctcgcctaccaatctctgctctctatgtatgtagcgtacgggttgttttgggtgaatcttgaggaataaatgcctttatatttcacaggctgtaaattgaacttcccacacgattagctttattatggcttgtgaactgctggagtctggctttacctttttgtatgtgaacaaatcaaattgcttaaaaaagagttttctttagtatagccacaaatgccttgaactgttgtctgggattgttttgtggggggagggaagggagtgttccgaagatgctgtagtaactgcctcagtgtttcacgtaagactttttggtttgatcatctttgttgaggtaggactatcagttccctctaaatgtatatgttgatttatgagtaattgttatttattctttatttatttatattaattatgaagattatgatattatttgattgcagatttttttggcgcgctgccccctccccaccctgccactcttgacattccactgtgcgttttagaagagagcctttttctaaagggatctgcttaaagttttaacttttatacctatctgagtgaattacagacaacctatcatttattctgcttcgagggtccccagggcccttgtacaaccgacagctcttacttttaaatgcaatctcttttctacatacattattttcttaattgttagctatttatagaaagcttcaatagaactgtttcaactgtataactatttactattcaaataaaatattttcaaagtc

SEQ ID NO: 14479 - DNA, 3013 bp, Homo sapiens
cgggagaaagccccgcccccggcgcccgctcccactcctgattggccgggccagcccggggaggcccggcgggaccccggcccgcgtctcagctataaagatagccccggcatgacagccgcggcgaagctcttctagttcatctgctggccggctctcagtccccgtggcgccccctttcctcttgtcccagagcgctctcgactccaccatgccaaggggattcctggtgaagcgaactaaacggacaggcggcttgtaccgagttcgccttgcggagcgtgtcttccctctgctggggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacggactgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgggagtgcccagcaaattttctcgtgcaagcactgcccgtccactttttttagctctccagggctgacccggcacatcaataagtgccacccctcagaaagccggcaagtgctgctgctgcagatgccactgcggcctggctgctgagggacgagagaccaggatgatttcgaggttggccttagaggaaacagatcatgggaatttctgtggggctttcttcaacttgcaagtttactttcattccttcctatgttttaatcccctaaaattctccctgtagtcaatgttccaccagaggagcggacagtgaaatgtaatatccctctctagagcaggtatgtatatggtataaaccttgagatcaaagactgtcagctttaaatccttctcactttccccactaaaataggatttttccccttaaaactctggagaccctaacgaatcctatatgatttgtaattcctatggaaagtcgcggtgaatgcgtgcatgtctcaatgtccacaaaggattctggctaccctttggtagccaatgttttttttgtcttgtcatcacaggcgcctatacagcttctgtctcaatagggtcagatattttgcactgtatattctgtgaattaaaagttatgtgattggtgtcaaacttaaggagattcaagacctggcagaaaatgtaagaggatttttgctgcttttggggtgcatggggatctcccctgtaaactttcctttgcccaattatatgtacatgtccattcttaagttggtgtttggaggtggggaggatgctactttactggagttgagacaccccctaaaattctcaccctcagctattttgtgggcagtattcaggaagagctacttcaaacctttctttaaatggctttttggaaatacagaagtcgtttcctcaagtttgactgttttaatggggtttcacccaaattgtttaatgcttctgctgtaaatgtcatactgtgtattcattatgaaaatatgtacagcttaaggaagatgttaacacctgtaatccactaaggaactgaatggcaatttgctcaatattcagtattttcttttcagcggcaacttgtttttgatttttttaaaaaaccatttcagtgtacattgtgtactaattccctactagccagtttgggacattggctgagcactgcctgacagaaagcccgtatttgtaagatgcttaccaccaaataaatgtacatagactgtg

SEQ ID NO: 14480 - DNA, 1641 bp, Homo sapiens
ataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 14481 - DNA, 1698 bp, Homo sapiens
gtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctat

SEQ ID NO: 14482 - DNA, 1876 bp, Homo sapiens
agtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaccttg

SEQ ID NO: 14483 - DNA, 1888 bp, Homo sapiens
ctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 14484 - DNA, 2078 bp, Homo sapiens
ggggttagagagagggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 14485 - DNA, 1889 bp, Homo sapiens
agagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctaggctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 14486 - DNA, 763 bp, Homo sapiens
agggaatgcgaagggattatgctacggagaacggatccgagcgtgacggctgaatgaatgagtgagcgagtgagtgagtgagtgagtgagcgagcgagtgagtgactgtgcgagcgagcggcagaaggaactccgacccgccccagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctggg

SEQ ID NO: 14487 - DNA, 3388 bp, Homo sapiens
cgcgcctgccggaagtgagcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaa

SEQ ID NO: 14488 - DNA, 1451 bp, Homo sapiens
gttgtttggaaagactcaggagctgctcggctggaaggcaatgactgaagtcatctgcatgttgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagca

SEQ ID NO: 14489 - DNA, 1464 bp, Homo sapiens
aacaatgtatttgctctgagttgcagccgattaacttttcttcagaggcaaatgtagacttatctctccttctcctgaccacccaccacactatacttaagaaaatggaaagggatagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaa

SEQ ID NO: 14490 - DNA, 1799 bp, Homo sapiens
ctagctccactgcttttttagcgtcggaagggcagccctagtgggagagagaaaaaggagccggcagcggctcttacgcgtcccggggctgcgcgccactctctcggccggaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatg

SEQ ID NO: 14491 - DNA, 1296 bp, Homo sapiens
ctaagaggtgttccccattcggcagccagactccttgaaataccctttcagtaatcattcaaccaacgcttccatgtctctactctgtcgtaacaaaggctgtgggcagcactttgaccctaataccaaccttcctgattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatcttgtattcttcagtttca

SEQ ID NO: 14492 - DNA, 1439 bp, Homo sapiens
atcattcaaccaacgcttccatgtctctactctgtcgtaacaaaggctgtgggcagcactttgaccctaataccaaccttcctggtgagtaaagaatcctgacctggccaggggctctgtgtgggtgttggggactggtcagctggggggcagtgtgtttgaggagcggggaaagaaactacctgccctagtttaattggtctgagtgatcttacagcctttgctggcttttttttttttcttcacattatatgggaagaaaccataaatagaaacccggggaagaggtgaaaaatgatacttggtatagttatcttcccttccttgataacttctactgatgtccacagattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaagg

SEQ ID NO: 14493 - DNA, 1963 bp, Homo sapiens
gtcaggactgcgcctgcgcatagtcttggaggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaa

SEQ ID NO: 14494 - DNA, 4859 bp, Homo sapiens
ttccgggcggggccgcgctcccggggcgcgggtggaggagcttggaaccacgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagtattttatttttttccagtcaaatgactagttaacaagaagagtaaacttattaaacatgctctaattataaatcactgcattaaggacaatgaaaataatcaatttcggttatacaatatatacagttgtgctgcaaccaaagtaatcaggtgaatgaactgaatatcatacatctcaaaatagcatcctaagctgcatattatgttatccaccccttaacagatcacacagttactcttagtctgtgtacatgttctgagccatcatcccagatctgatggagaatggcatgcaaaatgccagaatcctgcagctgcagttcatgaaacataaactttaaatataaatagatatctacaatgtttttctttctcttagttgcttttttaatttgcaaggagcaaataactaagaaaggatattagcagggtcgttaatataatttctcctctggtaagagtactattagttactgcacaatagcaccaaattgtagactggaaaaatatttcctaggtatttatgtaccagtgaacctgacagattagtttgggactggagttctaatgttgatatgaatcaactttattccttatatagctggcaccaggtggtcaaaaggctgactataaaatacagatgcaggaggattgttaaaatagacataagtgcactgtgcaaaatacatctgtttacttaaatctatgagaaaattaaatgaagggttcaaacagaaattaacaattagtgaaaacagatgtagtgctttaaaaaaaaacaaaaacaaaaaactacagatataacacatttttacccggaactttgaaaggtaaaaagcgattgctatacaacatcataaaacattccagtttgttctgtcttcctttataacaaaaacaaaaagtacaatgccaaaaaaaaaaaaaactctacacagtcttgcataataaagacaagctgcttcaatcaaatgcaccatcacaacaaatgcagttaacagcattgctgcctcactttccaagcctatatgcaaatttattcctttacttttgttaaaagtccaagtgggtatcatatgcctatttattctcagagtgccaaaatttccaatattcctactatgaatcttaccctcgcaattactaaatagaggtatgacagtcaagttcattaaacgaatgagttttggttttataatagacaacctaatcctctactaccaccccaagtagcttaagaatgatatgatggcctgaaacagtaaaaagtgggatgtttgggagtattacctgggacctatatatttctgatatgttcttgattataaacagatggacagattcaatttcaagacagtgtgactaccattcctgttggagtattatagaaatacaagacactaaactgagtaaacattctcctgggctagaagggaaggcagtggtacactcagtaggaaacagcaagtgatgtgttaatacagcatggtctgcgccacagaattctactgtgtacagttgctttctgtgtgactcaggaagttcaagaaggcaaattccaaaacacctaaagcatataaactaatttaaaagaactgttttgcaatccatcatccttagtttttaaccaaattcaggaaatgcagttttatataacctggaacagaatgaactgtagttaccctacgttgtcataaaccatcagtagttttgttaagtatgattgttcacaacaggttatacatacatgcagaatataatgatagctgcaacctcacaaattagggctagaaagtacaatgctaatgtgtaaatttccaagttgctttttaaacactgggtggatttcaaaggaatgtgtgtctttaaaggtgaactgatggcattttatcgagaaagttcagagctgggctatggacttctgaagcagcagttcactggccgcctaaaataataattgtgataaaggtcaccaactccagaactgggccaaggaatgcaggaagaatttattcattaatgcaaacatttttaggtttagctaattccgtagaggcaggatcttgattatgtataatagttaaaataacttttcagttcacctgttgggaaattcagtttttcctaataaatgcatagcaatgtttcatgaaaaccacaaattataaaaacaattactgatatgtaaaaa

SEQ ID NO: 14495 - DNA, 663 bp, Homo sapiens
agatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggc

SEQ ID NO: 14496 - DNA, 445 bp, Homo sapiens
gcctcttcctctgccccgcttcggccgcctcccgcctctcagggtcggggttgtctgtccccttcgctgtcacatcctccgcacccagcgcttggaaggtgctccatcacggtgacagacaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccag

SEQ ID NO: 14497 - DNA, 540 bp, Homo sapiens
gagctcgcggaggcctgacgggaacacggtcccgagagcggcgcggacggccaggaaggatgggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattaga

SEQ ID NO: 14498 - DNA, 748 bp, Homo sapiens
aaatatagaagtaaattggatgatgaggctgattaaaaagcttgggctcagtggtcagacttgggcaagtggcctaatgtcgtcccctagtaagtggacttagagtggggtctccaaatacggagaatctttgggttgcagcaggagctttcactgactgctgcgtgagttgctcgttctttttccttcatcaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctac

SEQ ID NO: 14499 - DNA, 699 bp, Homo sapiens
agatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtt

SEQ ID NO: 14500 - DNA, 659 bp, Homo sapiens
tccgggcggggccgcgctcccggggcgcgggtggaggagcttggaaccacgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaa

SEQ ID NO: 14501 - DNA, 1772 bp, Homo sapiens
gcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaa

SEQ ID NO: 14502 - DNA, 948 bp, Homo sapiens
gtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtg

SEQ ID NO: 14503 - DNA, 560 bp, Homo sapiens
ctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaaggtcagcctcagatgtcacaacctctgtga

SEQ ID NO: 14504 - DNA, 1044 bp, Homo sapiens
gttttcggaagttgctgggttcgttttattcagcggcagtggtgctttcccgaatctcagaatgccttttgctcccgttgcccaggctagagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtg

SEQ ID NO: 14505 - DNA, 8044 bp, Homo sapiens
ctcccgaaggtccagcccttacccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggaattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgtgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttatgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttcccttggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaagagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttaaactaatttccaaagaatttagctgaagactcagagtcagcctacctcttgactctccacatccgcatctaagatcctgaaggccaaaggaatgcgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattgttaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatatacatatatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaatccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgagtacca

SEQ ID NO: 14506 - DNA, 5001 bp, Homo sapiens
gcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgttt

SEQ ID NO: 14507 - DNA, 5004 bp, Homo sapiens
gcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggtggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgttt

SEQ ID NO: 14508 - DNA, 3009 bp, Homo sapiens
atcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacacacacacacacacacacacacacacacactgcctcccatccttccctcatgcccgccagtgcacagggaagggcttggccagcgctgttgaggggtcccctctggaatgcactgaataaagcacgtgcaagg

SEQ ID NO: 14509 - DNA, 2612 bp, Homo sapiens
agtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccaggg

SEQ ID NO: 14510 - DNA, 7869 bp, Homo sapiens
ttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagtta

SEQ ID NO: 14511 - DNA, 3487 bp, Homo sapiens
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcagttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctg

SEQ ID NO: 14512 - DNA, 3674 bp, Homo sapiens
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttg

SEQ ID NO: 14513 - DNA, 3530 bp, Homo sapiens
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttg

SEQ ID NO: 14514 - DNA, 3334 bp, Homo sapiens
attcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctg

SEQ ID NO: 14515 - DNA, 3232 bp, Homo sapiens
attcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctg

SEQ ID NO: 14516 - DNA, 1212 bp, Homo sapiens
actgtgaagcgggcttcagctccgtggtcactcaggccggagagctggtgcttggggctcctggcggctattatttcttagggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccaggtgccctggactgcctccagctagaaatgcccaagaaaggcccttggacattcgctggaagtgccaagagacacggccaggggctcatgcctggcctggtgtcccactatggactgccagaggggctgggtgaaacctccagtgggggaggtggtgtggggaacccctgggaagatgagatgaggatcccatgccctaatcgccaattctgacccattcctcgatgtctatagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacct

SEQ ID NO: 14517 - DNA, 4884 bp, Homo sapiens
tttccccggaaggaaagcgcagcccgggctgggctcgcaaggtggggaggtgcgggactgggcgtggggaggcggggcgcgcgccgggggacccctccctcctgtcctccttgcggtcgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtatgc

SEQ ID NO: 14518 - DNA, 4888 bp, Homo sapiens
agatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgt

SEQ ID NO: 14519 - DNA, 3448 bp, Homo sapiens
tttccccggaaggaaagcgcagcccgggctgggctcgcaaggtggggaggtgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccaca

SEQ ID NO: 14520 - DNA, 1810 bp, Homo sapiens
ctttccccggaaggaaagcgcagcccgggctgggctcgcaagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcagtgagtgctggggtgcagcgtaaaaggggtacgctcccctgtccccttgctgaccaccctgtctacctgtagccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtc

SEQ ID NO: 14521 - DNA, 7889 bp, Homo sapiens
ccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggacgaggcaaagaaagcagctgtcactcagagttcgcttatgagttttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttgaatgggatgccatttgcagctttcctttgatggactcttgttcataatgccatgttttctttaatgaatcatttaggattcttaggtgatatttctggaacagcaccatcaacagctttggccacatgcacttagagcaactaacttgcctcctgccggggtgtaggtgcgttggtgacagtgtagaagggtgattcgcaggcccatgttctgcccaccagcaaagccccactggagaagggtagactcctgtgggcagtctcagagctgggacctatttgcttctgcttgattctgcgtgggtggacccacatgagcagctgtatacccaggaggtcactaagactttataaaggcaggttttaagaaaaccagccttggcatcaccaccagcagatactgaaagcctccccaggaacctgtctggggaaggatgatgcctctgctggtctgatcgtgctgagtagcaggtgggctacggggactggggagttaagcattttgtgcagtgatagagaagtcaagcatatcgttagcgctctctcaacttgggcagttcacaagctccttcccagctcagaagccctctctatgctctcaggggaagcagatggggtggatcagtacatctgtgttacccttccagaatattatttgaaaattctacagtatgttctactttctccccttcctgcttccatggtttcactgtggaatcctataagatattctcctgagcagtattatttcagtttccttcagcttttagttgaatcttcaatgtggttttaaccaactgttcagagaactgaaatggtttttaaatatgaaaaaggacctttgtaaaaatggagtaaaacagtgccccttttttaaaaaaagttttgcttatgcttaatttacataggactcaggagagtttggaacatcctccaagtgggccatagagctgtcacaaagaagaggccatgatgtttagaaacaaggggacactagcaggaggggcagggtccactggcttagtggcaactgacaggcatccattccgaataactcagcactgaggtttcctcaggcagttctttaggaaaactgtcagcatcatgggtactcagaggtatggtagaccttgtagaagatccactaggaagtcctccttcaccaaatcatgtagctactgcccttgagccaaaggcaatgaggtttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcacttggagcctttagtagacaaaaggcagaaagtgagcatcatttcagaaatgctttagtatgcacacttttagctgatattttgatatatagaataataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttgggaaatgtcaggtttacaaaaacatacatgtttggaataaaaaatggctgcaaacaattcagaa

SEQ ID NO: 14522 - DNA, 1892 bp, Homo sapiens
attattttaactaccccctgggagggtgagcaccttctgtgctctgtccccaaccttccacttcccctcaacgcgctgctcagggatgaccttcggcactgtgcttcttctgagtgtcctggcttcttatcatggattcaacctggatgtggaggagcctacgatcttccaggaggatgcaggcggctttgggcagagcgtggtgcagttcggtggatctcgactcgtggtgggagcacccctggaggtggtggcggccaaccagacgggacggctgtatgactgcgcagctgccaccggcatgtgccagcctccaccaacggctcccggctcctggcctgtggcccgaccctgcacagagtctgtggggagaactcatactcaaagggttcctgcctcctgctgggctcgcgctgggagatcatccagacagtccccgacgccacgccagtttgcactgatgcagtactcaaacctcctgaagatccacttcaccttcacccaattccggaccagcccgagccagcagagcctggtggatcccatcgtccaactgaaaggcctgacgttcacggccacgggcatcctgacagtggtgacacagctatttcatcataagaatggggcccgaaaaagtgccaagaagatcctcattgtcatcacagatgggcagaagtacaaagaccccctggaatacagtgatgtcatcccccaggcagagaaggctggcatcatccgctacgctatcggggtgcgcctcttcttcacccctgccccaggctcagcctgcatctccttcaggtgcagtgctgctgggctcatcctcctcggctgtctctctgctgcaggtgggacacgctttccagggacccactgccaggcaggagctgaataccatcagctcagcgcctccgcaggaccacgtgttcaaggtggacaactttgcagcccttggcagcatccagaagcagctgcaggagaagatctatgcagttgagggaacccagtccagggcaagcagctccttccagcacgagatgtcccaagaaggcttcagcacagccctcacaatggtgggtagagcctgccctcaatccatagctcttggataccaactctgcacccaccctgggctgggggctgggagccagacataaacaagagcagaccccatcctcaatcgccagggagaggcccccacgcgtgtgttaggggccaggagcacagcagggaggagggtagcctgggttcctgctctcaaggatcatgtattctagtggaggagacagtaagcaagagcctctcagatagcactaagcatcagggtagagagagagatagccagaggagcctcagtaatggaaaaggccagccctggacaaatcaggggagactgttctgggcacaggacaaagcaagtgccaaggtcctgaggcaggacccaggtcctcggcgggagagatccgggcttgccagagcccagggagcccaggcagcctggaaggagagggctggaggctgagaaggaccaggtgggatcaaagatgtggtttggaagtgcgtgtgtgttcaaaggatccagatggggccggtcactgtggctcatgcctgtaatcccagcactttgggaggctgagacgggcggatcacttgaggtcaggagtttgagaccaactggccaacatggcgaaaccccacctctactaaaaatacaaaaaaattagccaggtgtggtggctcatgcctgtaatcctagctacttgggaggccaaggcaggagaattgcttgaacccaggaggcagaggttgcactgagccgagattgtgccactgcacttcagcctaggtgacagaacgagtctctgtctcaaaacaacaacaacaacaaaaac

SEQ ID NO: 14523 - DNA, 3912 bp, Homo sapiens
ctgtgctctgtccccaaccttccacttcccctcaacgcgctgctcagggatgaccttcggcactgtgcttcttctgagtgtcctggcttcttatcatggattcaacctggatgtggaggagcctacgatcttccaggaggatgcaggcggctttgggcagagcgtggtgcagttcggtggatctcgactcgtggtgggagcacccctggaggtggtggcggccaaccagacgggacggctgtatgactgcgcagctgccaccggcatgtgccagcccatcccgctgcacatccgccctgaggccgtgaacatgtccttgggcctgaccctggcagcctccaccaacggctcccggctcctggcctgtggcccgaccctgcacagagtctgtggggagaactcatactcaaagggttcctgcctcctgctgggctcgcgctgggagatcatccagacagtccccgacgccacgccagagtgtccacatcaagagatggacatcgtcttcctgattgacggctctggaagcattgaccaaaatgactttaaccagatgaagggctttgtccaagctgtcatgggccagtttgagggcactgacaccctgtttgcactgatgcagtactcaaacctcctgaagatccacttcaccttcacccaattccggaccagcccgagccagcagagcctggtggatcccatcgtccaactgaaaggcctgacgttcacggccacgggcatcctgacagtggtgacacagctatttcatcataagaatggggcccgaaaaagtgccaagaagatcctcattgtcatcacagatgggcagaagtacaaagaccccctggaatacagtgatgtcatcccccaggcagagaaggctggcatcatccgctacgctatcggggtgggacacgctttccagggacccactgccaggcaggagctgaataccatcagctcagcgcctccgcaggaccacgtgttcaaggtggacaactttgcagcccttggcagcatccagaagcagctgcaggagaagatctatgcagttgagggaacccagtccagggcaagcagctccttccagcacgagatgtcccaagaaggcttcagcacagccctcacaatggatggcctcttcctgggggctgtggggagctttagctggtctggaggtgccttcctgtatcccccaaatatgagccccaccttcatcaacatgtctcaggagaatgtggacatgagggactcttacctgggttactccaccgagctagccctgtggaagggggtacagaacctggtcctgggggccccccgctaccagcataccgggaaggctgtcatcttcacccaggtgtccaggcaatggaggaagaaggccgaagtcacagggacgcagatcggctcctacttcggggcctccctctgctctgtggatgtggacagcgatggcagcaccgacctgatcctcattggggccccccattactatgagcagacccgagggggccaggtgtccgtgtgtcccttgcctagggggagggtgcagtggcagtgtgacgctgttctccgtggtgagcagggccacccctggggccgctttggggcagccctgacagtgttgggggatgtgaatgaggacaagctgatagacgtggccattggggccccgggagagcaggagaaccggggtgctgtctacctgtttcacggagcctcagaatccggcatcagcccctcccacagccagcggattgccagctcccagctctcccccaggctgcagtattttgggcaggcgctgagtgggggtcaggacctcacccaggatggactgatggacctggccgtgggggcccggggccaggtgctcctgctcaggagtctgccggtgctgaaagtgggggtggccatgagattcagccctgtggaggtggccaaggctgtgtaccggtgctgggaagagaagcccagtgccctggaagctggggacgccaccgtctgtctcaccatccagaaaagctcactggaccagctaggtgacatccaaagctctgtcaggtttgatctggcactggacccaggtcgtctgacttctcgtgccattttcaatgaaaccaagaaccccactttgactcgaagaaaaaccctgggactggggattcactgtgaaaccctgaagctgcttttgccagattgtgtggaggatgtggtgagccccatcattctgcacctcaacttctcactggtgagagagcccatcccctccccccagaacctgcgtcctgtgctggccgtgggctcacaagacctcttcactgcttctctccccttcgagaagaactgtgggcaagatggcctctgtgaaggggacctgggtgtcaccctcagcttctcaggcctgcagaccctgaccgtggggagctccctggagctcaacgtgattgtgactgtgtggaacgcaggtgaggattcctacggaaccgtggtcagcctctactatccagcagggctgtcgcaccgacgggtgtcaggagcccagaagcagccccatcagagtgccctgcgcctggcatgtgagacagtgcccactgaggatgagggcctaagaagcagccgctgcagtgtcaaccaccccatcttccatgagggctctaacggcaccttcatagtcacattcgatgtctcctacaaggccaccctgggagacaggatgcttatgagggccagtgcaagcagtgagaacaataaggcttcaagcagcaaggccaccttccagctggagctcccggtgaagtatgcagtctacaccatgatcagcaggcaggaagaatccaccaagtacttcaactttgcaacctccgatgagaagaaaatgaaagaggctgagcatcgataccgtgtgaataacctcagccagcgagatctggccatcagcattaacttctgggttcctgtcctgctgaacggggtggctgtgtgggatgtggtcatggaggccccatctcagagtctcccctgtgtttcagagagaaaacctccccagcattctgacttcctgacccagatttcaagaagtcccatgctggactgctccattgctgactgcctgcagttccgctgtgacgtcccctccttcagcgtccaggaggagctggatttcaccctgaagggcaatctcagtttcggctgggtccgcgagacattgcagaagaaggtgttggtcgtgagtgtggctgaaattacgttcgacacatccgtgtactcccagcttccaggacaggaggcatttatgagagctcagatggagatggtgctagaagaagacgaggtctacaatgccattcccatcatcatgggcagctctgtgggggctctgctactgctggcgctcatcacagccacactgtacaagcttggcttcttcaaacgccactacaaggaaatgctggaggacaagcctgaagacactgccacattcagtggggacgatttcagctgtgtggccccaaatgtgcctttgtcctaataatccactttcctgtttatctctaccactgtgggctggacttgcttgcaaccataaatcaacttacatggaaacaacttctgcatagatctgcactggcctaagcaacctaccaggtgctaagcaccttctcggagagatagagattgtaatgtttttacatatctgtccatctttttcagcaatgacccactttttacagaagcaggcatggtgccagcataaattttcatatgcttaagaattgtcacatgaaatgaggatgtttatagcacactttccttgcgtggaagagctataacccagggacctgagtgcctctctgggaatagtcgggggaacctatttgtgggcattgaaaaagttttttcactttc

SEQ ID NO: 14524 - DNA, 3912 bp, Homo sapiens; identical to SEQ ID NO: 14523

SEQ ID NO: 14525 - DNA, 5208 bp, Homo sapiens
acacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgcagggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcc

SEQ ID NO: 14526 - DNA, 4956 bp, Homo sapiens
acacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcc

SEQ ID NO: 14527 - DNA, 1416 bp, Homo sapiens
ctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccgatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctgg

SEQ ID NO: 14528 - DNA, 833 bp, Homo sapiens
cctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagacc

SEQ ID NO: 14529 - DNA, 4742 bp, Homo sapiens
ttttctgcccttctttgctttggtggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataa

SEQ ID NO: 14530 - DNA, 4745 bp, Homo sapiens
ttttctgcccttctttgctttggtggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataa

SEQ ID NO: 14531 - DNA, 4649 bp, Homo sapiens
agtaccttggtccagctcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcagctcaaaccccctcagcctgttggcttctgttcaccagctgcaagggtttacatacacggccaccgccatccaaaatgtcgtgcaccgattgttccatgcctcatatggggcccgtagggatgccgccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacagcgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgccgatgctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaggacttgacttgcaatttctacctagaaatacatggacaatacccccaggcctcagtctcccttctcccatgaggcacgaatgatctttctttcctttctttttttttttttttcttttcttttttttttttttgagacggagtctcgctctgtcacccaggctggagtgcaatggcgtgatctcggctcactgcaacctccgcctcccgggttcaagtaattctgctgtctcagcctcctgagtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctcttgggaaatatgtcaaaggtctaaaaataaaaaagccttctgtg

SEQ ID NO: 14532 - DNA, 5918 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgct

SEQ ID NO: 14533 - DNA, 5867 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgct

SEQ ID NO: 14534 - DNA, 5688 bp, Homo sapiens
ggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgct

SEQ ID NO: 14535 - DNA, 5269 bp, Homo sapiens
gggggtattgaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgct

SEQ ID NO: 14536 - DNA, 4675 bp, Homo sapiens
ttgaagttgcttttaaacacagcttttctgctttacctgtccaggtagcctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattagggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaacctta

SEQ ID NO: 14537 - DNA, 2501 bp, Homo sapiens
atgttgaagttgcttttaaacacagcttttctgctttacctgtccaggtagcctctgttttcatttcagtcttaatgaaaactttctaacttatatctcaagtttcttttcaaagcagtcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctag

SEQ ID NO: 14538 - DNA, 2861 bp, Homo sapiens
aaatcttccccaccctggggagtgtcacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 14539 - DNA, 2324 bp, Homo sapiens
gctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctc

SEQ ID NO: 14540 - DNA, 2791 bp, Homo sapiens
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcaga

SEQ ID NO: 14541 - DNA, 1523 bp, Homo sapiens
aaactttgtctcatgaacttagttgcagtgatgggagcatttaataaaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtc

SEQ ID NO: 14542 - DNA, 2494 bp, Homo sapiens
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttta

SEQ ID NO: 14543 - DNA, 2491 bp, Homo sapiens
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttt

SEQ ID NO: 14544 - DNA, 2155 bp, Homo sapiens
agagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccacgtgactgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttt

SEQ ID NO: 14545 - DNA, 1863 bp, Homo sapiens
atcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaacta

SEQ ID NO: 14546 - DNA, 1033 bp, Homo sapiens
tctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaataaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaagacaccacagagaccggaaggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgccaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctg

SEQ ID NO: 14547 - DNA, 1183 bp, Homo sapiens
aggagcgtttttggagaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcacgagaatgacatgcgtgggaagtgcacggtgggcgatcgctggtccagtcagcagggcagcaaagcagtctacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaag

SEQ ID NO: 14548 - DNA, 1151 bp, Homo sapiens
gcaggggagctccgagtgtccacaggaagggaactatcagctcctggcatctgtaaggatgctgtccatgctgaggacaatgaccagactctgcttcctgttattcttctctgtggccaccagtgggtgcagtgcagcagcagcctcttctcttgagatgctctcgagggaattcgaaacctgtgccttctccttttcttccctgcctagaagctgcaaagaaatcaaggaacgctgccatagtgcaggtgatggcctgtattttctccgcaccaagaatggtgttgtctaccagaccttctgtgacatgacttctgggggtggcggctggaccctggtggccagcgtgcacgagaatgacatgcgtgggaagtgcacggtgggtgatcgctggtccagtcagcagggcaacaaagcagactacccagagggggatggcaactgggccaactacaacacctttggatctgcagaggcggccacgagcgatgactacaagaaccctggctactacgacatccaggccaaggacctgggcatctggcatgtgcccaacaagtcccccatgcagcattggagaaacagcgccctgctgaggtaccgcaccaacactggcttcctccagagactgggacataatctgtttggcatctaccagaaatacccagtgaaatacagatcagggaaatgttggaatgacaatggcccagccatacctgtggtctatgactttggtgatgctaagaagactgcatcttattactcaccgtatggtcaacgggaatttgttgcaggattcgttcagttccgggtgtttaataacgagagagcagccaacgccctttgtgctgggataaaagttactggctgtaacactgagcatcactgcatcggtggaggagggttcttcccacagggcaaaccccgtcagtgtggggacttctccgcctttgactgggatggatatggaactcacgttaagagcagctgcagtcgggagataacggaggcggctgtactcttgttctatagatgagacagagctctgcggtgtcagggcgagaacccatcttccaaccccggctatttggagacggaaaaactggaattctaacaaggaggagaggagactaaatcacatcaatttgcaa

SEQ ID NO: 14549 - DNA, 2911 bp, Homo sapiens
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtcca

SEQ ID NO: 14550 - DNA, 2486 bp, Homo sapiens
gaattattgctggcacctaagtggtggctgagttgagggatgcaggcatgtacaccttcatttggtcagtatttttggagtgcctactgagtaccaggccctgtgatcagggctgggtgggtgctgcacacagtaggtggccaggacacatgctggctcttggctgagacttgattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtcc

SEQ ID NO: 14551 - DNA, 2741 bp, Homo sapiens
gtgcgtgcctgcccaactcccatgccttctcccaggggtgccgcttactagtcccagcttaagaacaaggatcggagtggccagataacgcagagcatctcctcattctagaagggccacagaccagccctggctttgaggggaggaagaagccctttagtacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtcc

SEQ ID NO: 14552 - DNA, 2778 bp, Homo sapiens
aggtgacagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaaaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtcc

SEQ ID NO: 14553 - DNA, 3193 bp, Homo sapiens
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctaactgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatgccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 14554 - DNA, 3033 bp, Homo sapiens
atataaggagcgtgggccaggcctgagtattcagcgatggcatttgcatggtggccctgtctcatcttggctctgctctccagcttggcagcctcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaaggcttttcagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 14555 - DNA, 3038 bp, Homo sapiens
atataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaaggtggggatagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 14556 - DNA, 3007 bp, Homo sapiens
tcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 14557 - DNA, 3002 bp, Homo sapiens
atataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaaaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaaggtggggatagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 14558 - DNA, 3336 bp, Homo sapiens
aacctgcccccatgtgggtggggcagcaaacaagttactaatccattccccacttgctgtcgagttcagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactacaaaaaaaaaaaaaaaa

SEQ ID NO: 14559 - DNA, 3235 bp, Homo sapiens
taatccattccccacttgctgtcgagttcagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcctgcccttcctgctccaggagccgtgccccggctgtcccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 14560 - DNA, 2872 bp, Homo sapiens
agaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaa

SEQ ID NO: 14561 - DNA, 2109 bp, Homo sapiens
acttgctgtcgagttcagaagcctcctggcagacactggagccacgatgaagcccccaaggcctgtccgtacctgcagcaaagttctcgtcctgctttcactgctggccatccaccagactactactgccgaaaaggatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatct

SEQ ID NO: 14562 - DNA, 2834 bp, Homo sapiens
agaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctggg

SEQ ID NO: 14563 - DNA, 6722 bp, Homo sapiens
gtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggacaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaatagaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagaggggacttccagagtcaatgaacgtcacccttcagcggacggataccgggagcgcttgggcgaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcatgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgttgctactttaagagctgagaaaaacattccaatgagctatccatagctaacttgcttgctcagaaaaacataagtaacaaagttgagctttcatttttaaaaattatattttactttagaaaaatatcaccttttttcttcctcttctttacgtgtagatcttttttttttttttcaaatggggtcagtacctgaaagcccgaaaccccataccaagcttatagttaggacctttgcatttgataaaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgacccccgacggccccatgctaggtgcaccatcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtgtcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattgggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcgtctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagctactcaagtctgtggtattcttgttaaggcagcccaagctgactaagacaccaaatcattcaaaacgttaattctttttctgttctttaagcttcccagaatgtacacaaacaatgctgttattaaaatttaaaggactcttggaactgtaggacatgatccagctaaaataaataacaaataacacagctaagcaaatacttataaatgtagctttaaatatttattttagttttaaataattagtggggtacgagacagttcacattcaagagacattttacttagacaaaaaatttataagagaacgatgcataaaaacaaacaacatattggtctgtttatttttctaagggaaaatggaattggagctgttgagaataaaacttgaagaatctaactgca

SEQ ID NO: 14564 - DNA, 2917 bp, Homo sapiens
cgccttgtagacgtgttcgctttgcgtttgccttctgcgtgattgtaagtttcccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggacaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaatagaaa

SEQ ID NO: 14565 - DNA, 3132 bp, Homo sapiens
gaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataataaaaattcagaggaaagaacaacctatgactgggttttgttctgctgtgtccagatcatcctctggaagtcttgattgttgcctttctgctgctgtgctgtacgtgcaagttcctaaagccagggacatcccggagatgagctgtggatatagagtccgcacagcctgcgggagacagaatgtaattccttccaacacacacacacaggctttatggaatgccagaaaagcttcctcttggatgctgcctggagtaatgactttttgaccctcccctcttttttggagcaagcactatctttccttgtaaagaaatttggacaatttgagtagaaatggtgtggtatgtgcacatagaaactctcagaaaactgtcagatgagctagacagttgtcctctatctccatgggtcccgcatcccaaggatcgaaccaacaacagatcaaaaatacgtgaaaaaggaattgcatctgtattgaatgtgtacggactttttttcttgtctttgttccttaaacaatgtagtgtaacaactatttacatcgcatctcctttgcattcattattataagtaaactagagatgatttaaagtgtatagaaaggctgcgtgcagtggctaatgtctgtaatcccagcactttgagaggccgaggcaggtggatcacctgaggtcaggagttcgagaccagcctggccaacgtggtgaaaccccatctctactaaaaatacaataattagctgggcatggtggtgcacgcctgtaatcccagctattcgggaggctgaggcaggagaatcgcttgaacccaggaggcagagattgcagtgaaccgagattgcaccattgcactccagcctgggtgacagagtgaacctccgtctcaaaaacaaaataaataaataagaataaatt

SEQ ID NO: 14566 - DNA, 2194 bp, Homo sapiens
gaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccaccaaactccgtcaaaaaaaaacaaaacaaaacaaaaaaaagacatgggagagatggtgtttttcctctccaccacctggggatacgatga

SEQ ID NO: 14567 - DNA, 2932 bp, Homo sapiens
gaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatgcttggccggggaatgtccagggagctctga

SEQ ID NO: 14568 - DNA, 3246 bp, Homo sapiens
caagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 14569 - DNA, 1296 bp, Homo sapiens
aaaggatcacgcgccccagtcgacgctgagctcctctgctactcagagttgcaacctcagcctcgctatggctcccagcagcccccggcccgcgctgcccgcactcctggtcctgctcggggctctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggt

SEQ ID NO: 14570 - DNA, 1334 bp, Homo sapiens
ggagaagactgaataagccgtgaactgggcagctgtgacacgcgcaccttgtcaccttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 14571 - DNA, 1252 bp, Homo sapiens
ggagaagactgaataagccgtgaactgggcagctgtgacacgcgcaccttgtcaccttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 14572 - DNA, 1211 bp, Homo sapiens
gccctgcttatcagcagcttcccagcttcctctgcctggattcttagaggcctggggtcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 14573 - DNA, 1154 bp, Homo sapiens
ggcagctgtgacacgcgcaccttgtcaccttgtcaccaatttcctgcccgggatcccagagctacccttcttggagcccacaggggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggaca

SEQ ID NO: 14574 - DNA, 1103 bp, Homo sapiens
ctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 14575 - DNA, 1778 bp, Homo sapiens
ccttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctctcagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccct

SEQ ID NO: 14576 - DNA, 1196 bp, Homo sapiens
gctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagc

SEQ ID NO: 14577 - DNA, 1273 bp, Homo sapiens
gctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagc

SEQ ID NO: 14578 - DNA, 1420 bp, Homo sapiens
gctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagc

SEQ ID NO: 14579 - DNA, 3001 bp, Homo sapiens
ccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaagga

SEQ ID NO: 14580 - DNA, 6139 bp, Homo sapiens
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtcactttgaatgccaggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcaccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttctgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattgtgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaaggaggctcttcagtctcacagataagtagatctctcctgctgtctggacacatttcactcggaaattgaatacaatttgtattcaggctgggaacctgaacacacacttgtgtttttaagcttcccttttttacagtggacaaggacacaaataataaataaatcatccctaatgcccaagaaatgccctggtacttagtaataacaaaataccagtaacttc

SEQ ID NO: 14581 - DNA, 1950 bp, Homo sapiens
tcagccacttcctccttccagcctcatctggttcccaggccgctggggactcccaacgccactgtccaagactctagggtcagcaagcgccccgggcggagaagggcgaggacgaagagcgccgggccgcgaccaggagcccacccgcgccctccgactgcagacatggggaagagacgcgggaactccaaagtcgctgggtctgcgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcct

SEQ ID NO: 14582 - DNA, 1878 bp, Homo sapiens
gtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaatgacgctgtatgtgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctact

SEQ ID NO: 14583 - DNA, 2899 bp, Homo sapiens
cccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaa

SEQ ID NO: 14584 - DNA, 2889 bp, Homo sapiens
gcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagtt

SEQ ID NO: 14585 - DNA, 1389 bp, Homo sapiens
gcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctg

SEQ ID NO: 14586 - DNA, 4335 bp, Homo sapiens
gccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcacttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaa

SEQ ID NO: 14587 - DNA, 876 bp, Homo sapiens
gctcggggttggagccagcgaccgtcggtagcagcatggctctcctctttctcctaccccttgtcatgcagggtgtgagcagggctgagatgggcaccgcggatctggggccgtcctcagtggccataatataattgtgataatgtaataaaatcaggaaacattacctgaagcagatgcttttgaagtcaccagaaaatagtcttctccaattccaatttaaatatggagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagattaaaagaagctgtgcattttcactgttttcttttttcatctagatccagtataaaatactcacgcagaaggaagatgattgtgacgagattcagtgccagttagcgattccagtatcctcactgaattctcagtactgtgtttcagcagaaggagtcttacatgtgtggggtgttacaactg

SEQ ID NO: 14588 - DNA, 2139 bp, Homo sapiens
gcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactcg

SEQ ID NO: 14589 - DNA, 748 bp, Homo sapiens
gcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtggccataatataattgtgataatgtaataaaatcaggaaacattacctgaagcagatgcttttgaagtcaccagaaaatagtcttctccaattccaatttaaatatggagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgta

SEQ ID NO: 14590 - DNA, 2055 bp, Homo sapiens
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactcttttgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 14591 - DNA, 753 bp, Homo sapiens
gcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaag

SEQ ID NO: 14592 - DNA, 1648 bp, Homo sapiens
gcagtccgtcttaggtctcagtctggaagtggtggattgccggcactcactagcagatttggcatgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagactttttttttttt

SEQ ID NO: 14593 - DNA, 2221 bp, Homo sapiens
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaaagcccgggggtctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgctgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 14594 - DNA, 844 bp, Homo sapiens
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctac

SEQ ID NO: 14595 - DNA, 855 bp, Homo sapiens
ctagtcctgacttgagtttctgatgaggaagcctctctccttagccttcagcctttcctcccaccctgccataaagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 14596 - DNA, 655 bp, Homo sapiens
aaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtcgtccctgttcaacaccctcttcttgaatgctgtctgggcttcatagcattcgcctactccgtgaagtctagggacaggaagatggttggcgacgtgaccggggcccaggccctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtg

SEQ ID NO: 14597 - DNA, 730 bp, Homo sapiens
gtcagttctccccagagtccccgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 14598 - DNA, 648 bp, Homo sapiens
atcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtcgtccctgttcaacaccctcttcatgaatgctgcctgggcttcatagcattcgcgtactccgtgaagtctagggacaggaagatggttggcgacgtgaccggggcccaggccctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 14599 - DNA, 659 bp, Homo sapiens
atcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 14600 - DNA, 444 bp, Homo sapiens
ccccccaactatgagatgctcaaggaggagcacgaggtggctgtgctgggggcgccccacaaccctgctcccccgacgtccaccgtgatccacatccgcagcgagacctccgtgcccgaccatgtcgtcgtccctgttcaacaccctcttcatgaatgctgcctgggcttcatagcattcgcctactccgtgaagtctagggacaggaagatggttggcgacgtgaccggggcccaggccctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatc

SEQ ID NO: 14601 - DNA, 808 bp, Homo sapiens
tgctcccttgggctctagagaggaagcccctcttagccctcagcccctctttcctccctctcctaaagtaatttgatcctcaggaatttgttccgccctcatctggccccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgctgctg

SEQ ID NO: 14602 - DNA, 3595 bp, Homo sapiens
aacagaaaccaaagtcaggcaaactctgtaagaactgcctgacagaaagctggactcaaagctcctacccgagtgtgcagcaggatcgccccggtccgggaccccaggcgcacaccgcagagtccaaagtgccgcgcctgccggccgcacctgcctgccgcggccccgcgcgccgccccgctgcccacctgcccgcctgcccacctgcccaggtgcgagtgcagccccgcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgca

SEQ ID NO: 14603 - DNA, 1617 bp, Homo sapiens
caaactctgtaagaactgcctgacagaaagctggactcaaagctcctacccgagtgtgcagcaggatcgccccggtccgggaccccaggcgcacaccgcagagtccaaagtgccgcgcctgccggccgcacctgcctgccgcggccccgcgcgccgccccgctgcccacctgcccgcctgcccacctgcccaggtgcgagtgcagccccgcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcaggtatttgtaattttactgaggaagattcttcaaattctgcctagtgattgagaattcaataaagcagaaagacacaatgctaaacaccaagatttttagaatcaaaattttaagagtggaacatatgtgatagatcatctattttatcaccttaacaaatgaggaaattgatgcctgggaaaatatcaactgatcaaagaccatttttcatccaaccaacactctttctactaccttattttaaaaacaatatgactaccagaaattttatcaagattatgtaacattaaatatacacaaatacattggaagaaagtattttagtggttataaaaaatctgctgcatattcttctgaacatttttatacattttaagcaatgtattaagcatttgataaaaggattgttttgtcaatatatctcaaccttacctaatgtgagattttaaacagcattcaataatagtaataacataacattttatagctccttctcctacattatttgtaaatctcacttaaactgctatcttatttttcttttcgtagtatgcatcctatgtttccaaaaatatcatatgaaagacaaattgaaagttaactattaattaattataa

SEQ ID NO: 14604 - DNA, 3452 bp, Homo sapiens
acagaaaccaaagtcaggcaaactctgtaagaactgcctgacagaaagctggactcaaagctcctacccgagtgtgcagcaggatcgccccggtccgggaccccaggcgcacaccgcagagtccaaagtgccgcgcctgccggccgcacctgcctgcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgatt

SEQ ID NO: 14605 - DNA, 2303 bp, Homo sapiens
ggatttccagccgcggctcttcgcagtttcctctccttgttttgctttcgatctggactgttctcaggcaagccggggagtaacttttagttttgctcctgcgattattcaactgacgggctttcatttccatttcacataccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatca

SEQ ID NO: 14606 - DNA, 665 bp, Homo sapiens
ctctccttgttttgctttcgatctggactgttctcaggcaagccggggagtaacttttagttttgctcctgcgattattcaactgacgggctttcatttccatttcacataccctagcaacacttataccttgcggaattgtattggtagcgtgaaaaaagcacactgagaggggcaaaacacaccttttgaggtctgtggagctcaaaaatgaagtcaaaggtgactgggtgacacaaacagctcagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaag

SEQ ID NO: 14607 - DNA, 498 bp, Homo sapiens
gattttaggggaagcaggttctgctgctgttgctgctgctactggggctgctgaggctgcgaggaggaggaggaggaggagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaag

SEQ ID NO: 14608 - DNA, 595 bp, Homo sapiens
gcagatgcggagaggtggctccatggacacagacctgctgtgtgtgcttctgcgccccagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatag

SEQ ID NO: 14609 - DNA, 568 bp, Homo sapiens
cagatgcggagaggtggctccatggacacagacctgctgtgtgtgcttctgcgccccaggtgttgtgtgtgggggtgcagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcct

SEQ ID NO: 14610 - DNA, 1690 bp, Homo sapiens
gctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatg

SEQ ID NO: 14611 - DNA, 903 bp, Homo sapiens
atgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctga

SEQ ID NO: 14612 - DNA, 1613 bp, Homo sapiens
ggaaacccaaaaaagggcataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 14613 - DNA, 315 bp, Homo sapiens
atgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggagttggggacttttcccagccagacacctctccggacaccaatggtggaggcagtacttctgatacccaggaagacattctggatgagttactgggtaacatggtgttggccccactcccagatccgggacccccaagcctggctgtag

SEQ ID NO: 14614 - DNA, 1494 bp, Homo sapiens
gagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgatggtggggcgcaagcagggttggagctgcagggttacgggaataaaaccgggaaagccggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 14615 - DNA, 710 bp, Homo sapiens
gagtttgagagctacccggagctccaagacaggggtgggttccagctgcccgcacgccccgaccttccatcgtaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 14616 - DNA, 1117 bp, Homo sapiens
tgacgggaaagggggtgcgcagcctcgagtttgagagctacccggagctccaagacaggggtgggttccagctgcccgcacgccccgaccttccatcgtaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 14617 - DNA, 1055 bp, Homo sapiens
gagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 14618 - DNA, 882 bp, Homo sapiens
gagtttgagagctacccggagctccaagacaggggtgggttccagctgcccgcacgccccgaccttccatcgtaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 14619 - DNA, 4306 bp, Homo sapiens
cttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctacgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 14620 - DNA, 1027 bp, Homo sapiens
ctttaccagactcagtagtggagacgtgttctcagcctttgtcgccagtgttcccaagccttctcccagacactggattgttgtatggatagccagctgagacccctccttttctccatacagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcc

SEQ ID NO: 14621 - DNA, 1472 bp, Homo sapiens
tgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttaga

SEQ ID NO: 14622 - DNA, 3012 bp, Homo sapiens
agtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaa

SEQ ID NO: 14623 - DNA, 1856 bp, Homo sapiens
atccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctacacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgccatcactgggtcctcttcttattcttctctccaagctgggttaacagtagacaggacccatttctgtgtgatgttaggagggaatgaagtcttatgctggggaggtgggcaagtatcaatttccttaatatcttgaatcctgtgggtccaaaatgtggcttggaaatctaagtagcatgtggcttaattactaatcccaccctttgctgttgcatcccagccctattcctggtgcatttatgcccagagaggtggcattatttcctggggtggcattcagctcctcttgagttggtgccacagcatttgtgggctttgaagcaaaggtacaggaaatgtcaagggtgccaccccggcaaccttgagcaagtcacccctcctatttgtaaaatgaggaaggaaaggtaacaaactgtggagtcagagagaagtaggttggaatcctctttgtcatttagtagctgtttgacctaaggtggtttactgaacttctcagtttctccatctgtaaaatgagaattctagcaactcgtagggtatttgtgagatgttgcaggcaaagcccccagcaccatgcctgtcctagcttaagcacccaccaggtgtcgataagtaattgttcttccctggactgcctgcacatctagggcaccccaggaagagtcaccgcactctgtttcggggctcggctctctgaggggagggcatcctgtatggggaggagggtctggaccagagctgtccctgatcgctagaatcaacggcagaattcttgttattttaataataattaataatttagtgcttccactaaataaaaatcattggaatggtg

SEQ ID NO: 14624 - DNA, 800 bp, Homo sapiens
tatggtcattacaggtggtcagctgtagctggatgtgtgccttgaaaggctgacaagtttgccctgagtgactcacctactgtcacctgatccaacaagatttgtgggcgtagcctgccgatgggtgacgccagttaaagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctacacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatag

SEQ ID NO: 14625 - DNA, 3303 bp, Homo sapiens
ttagctggacccgtctgggaggtaggtttgtgagcgtgagagatcgatctgtaccgcggggatccgaagtatgcttatccaggtgggctgcctcaagcctcgatcccacccccgcgctggtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttatctacgccatacttctcactgtttttgagcatacctagatgttcctttcctaggcggagtatagatcgcacgtgttctagcctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacacctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgagacgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaa

SEQ ID NO: 14626 - DNA, 2310 bp, Homo sapiens
gcgggccaagttccagttcccgccccttgccgtacactcctctcctcttacggaagtgaagccggaggtgtccggcgggctgcagttccggtttatcgcggccttcccacaccttcgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcgcaccgatttccgcatccggctccggacgcttccggtcttagctggacccgtctgggagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacacctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaa

SEQ ID NO: 14627 - DNA, 635 bp, Homo sapiens
ttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 14628 - DNA, 661 bp, Homo sapiens
gggaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggaggtgagtctgtggtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttc

SEQ ID NO: 14629 - DNA, 661 bp, Homo sapiens
gggaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgcttccattgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttc

SEQ ID NO: 14630 - DNA, 683 bp, Homo sapiens
gggggtaagagacagtgagtgcccaaacacagcgtcctgtacagacagcttgggcgttgttctcagggaagactgcgcctcgaagatccttggaggaaaccaaagtgggctcccagccaggttcgctgcttctgtctctgtctctgtctcgttattctcaccgctccagccattaaggaagagcacaccggacccgaaggatgcagcatgtgacagaatctccttcctcgataaggctgaatgacattccaccggaggtatagaccacatttggttgatccattcacccatcagtggacacttgggctgcttccacctctcggctattgtgcatagtgctgctatgtacgtgggggcagtgcttcagtcggggtggagctgcttaaaaggcctgggatcacaccctttgggaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctcc

SEQ ID NO: 14631 - DNA, 218 bp, Homo sapiens
acatccaagcttaagacggtgaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcggga

SEQ ID NO: 14632 - DNA, 716 bp, Homo sapiens
ggcaggagctacccttcccgtggccccggaccttgggtgggctgtgggctcagggagcggaggggaggccttaagcatccactctctgcccggtgtttttgttctcatcagggagcctcagatgggaagggactcgagccccacctgtccctggactctggaatgccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 14633 - DNA, 275 bp, Homo sapiens
cggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggag

SEQ ID NO: 14634 - DNA, 355 bp, Homo sapiens
gcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaa

SEQ ID NO: 14635 - DNA, 2900 bp, Homo sapiens
attgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaagg

SEQ ID NO: 14636 - DNA, 2564 bp, Homo sapiens
attgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaagg

SEQ ID NO: 14637 - DNA, 2099 bp, Homo sapiens
tcatcaacatgcattcccagaaatgccatgaaaggaaagaccaagtcttgactgagaaacggaccgggcagatgagggactcccacatatacctgtttcctgctcttcccgaagacattttgccacaagcatataattcagcttctgaaaaatacggtcttcctcactgcagacaccatgccagcgttttaaatcaagttggctactcgtgctgtttagagtatgcagtttgcctgtggcaatattaaactcatctggaagaaagcacttaaacctatccagttcctcatcggtgatgttatccaggctggttagcaagagtatctccttatatttactctccatctcacgacttttcagcttataagggatccaaactatgtaagattataccaccaaaagtgattcaacattcaaaatgaagcaagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtg

SEQ ID NO: 14638 - DNA, 2731 bp, Homo sapiens
gtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 14639 - DNA, 2704 bp, Homo sapiens
ggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaa

SEQ ID NO: 14640 - DNA, 630 bp, Homo sapiens
agactactcaggcgtgcactgcgaggtggagatctgacttctcttgttcccgcttaagactgcctcctgtatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcag

SEQ ID NO: 14641 - DNA, 2609 bp, Homo sapiens
attttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtg

SEQ ID NO: 14642 - DNA, 835 bp, Homo sapiens
gcattttccaggattttcaagtcttcgatgctgtcatgttgagagtccactatccacgtttgtttatccaggaataatgcagaaaatctgagcattcgtgaatctaatcattgagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttctt

SEQ ID NO: 14643 - DNA, 1711 bp, Homo sapiens
cttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaa

SEQ ID NO: 14644 - DNA, 1032 bp, Homo sapiens
ggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagc

SEQ ID NO: 14645 - DNA, 1514 bp, Homo sapiens
gatctggtaaacctgaagcaaatatagaaacctatagggcctgacttcctacataaagtaaggagggtaaaaatggaggctagaataagggttaaaattttgcttctagaacagagaaaatgatttttttcatatatatatgaatatatattatatatacacatatatacatatattcactatagtgtgtatacataaatatataatatatatattgttagtgtagtgtgtgtctgattatttacatgcatatagtatatacacttatgactttagtacccagacgtttttcatttgattaagcattcatttgtattgacacagctgaagtttactggagtttagctgaagtctaatgcaaaattaatagattgttgtcatcctcttaaggtcatagggagaacacacaaatgaaaacagtaaaagaaactgaaagtacagagaaatgttcagaaaatgaaaaccatgtgtttcctattaaaagccatgcatacaagcaatgtcttcagaaaacctagggtccaaggttaagccatatcccagctcagtaaagccaggagcatcctcatttcccaatggccctcctgttccctctactggcagccctagtgatgaccagctatagccctgttggatctctgggctgtgatctgcctcagaaccatggcctacttagcaggaacaccttggtgcttctgcaccaaatgaggagaatctcccctttcttgtgtctcaaggacagaagagacttcaggttcccccaggagatggtaaaagggagccagttgcagaaggcccatgtcatgtctgtcctccatgagatgctgcagcagatcttcagcctcttccacacagagcgctcctctgctgcctggaacatgaccctcctagaccaactccacactggacttcatcagcaactgcaacacctggagacctgcttgctgcaggtagtgggagaaggagaatctgctggggcaattagcagccctgcactgaccttgaggaggtacttccagggaatccgtgtctacctgaaagagaagaaatacagcgactgtgcctgggaagttgtcagaatggaaatcatgaaatccttgttcttatcaacaaacatgcaagaaagactgagaagtaaagatagagacctgggctcatcttgaaatgattctcattgattaatttgccatataacacttgcacatgtgactctggtcaattcaaaagactcttatttcggctttaatcacagaattgactgaattagttctgcaaatactttgtcggtatattaagccagtatatgttaaaaagacttaggttcaggggcatcagtccctaagatgttatttatttttactcatttatttattcttacattttatcatatttatactatttatattcttatataacaaatgtttgcctttacattgtattaagataacaaaacatgttcagctttccatttggttaaatattgtattttgttatttattaaattattttcaaac

SEQ ID NO: 14646 - DNA, 1241 bp, Homo sapiens
ggcagggggcggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccagatgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaacggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 14647 - DNA, 1232 bp, Homo sapiens
gtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatgatgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaacggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 14648 - DNA, 1687 bp, Homo sapiens
cattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggtctaa

SEQ ID NO: 14649 - DNA, 686 bp, Homo sapiens
attttgtgcctgcctagctatccagacagagcagctaccctcagctctagctgatactacagacagtacaacagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttc

SEQ ID NO: 14650 - DNA, 497 bp, Homo sapiens
ctctttctgacatctcggtggttagcaattattcctctgagtgggagctggaccctgtaaaggatgttctaattctttctgctctgagacgaatgctatgggctgcagatgacttcttagaggatttgccttttgagcaaataggtagatggtttggtggtgtggaagcttggaagcggtcagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggtctaa

SEQ ID NO: 14651 - DNA, 1530 bp, Homo sapiens
attttgtgcctgcctagctatccagacagagcagctaccctcagctctagctgatactacagacagtacaacagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaaggtaatgaatgatgcccttcgtaaacacattttctggggtatgttactacaatcacatactagtgtgtataaaaataaaaacaagcagctactgggtttaagaagaattacaaaattacttaaatagggcccgtttcccaagatttaaaaattaaatacagttgttccttggtatttgcaggggattagttccaggactttgcattgttaccaaaatctgtggatgcttaatggcatagtatttgtatttgcatataacctatgcacatcctttggtatactttaaataatatctagattacttataatacctaacccaaattaaatgctttgtaaatagttgttctactctatttttcattattaatgacaagaaaataacctgtacatgttcagtacagatgaaatattttttcaaaatttatttttttgagatgaagtttctgttgcccaggctggagtgcagtggcatgatttcggctcactgcaacctccgcctcctgggttcaagtgattctcctgcctctgtctctcagcagctgggattacaggcacatgccaccatgcctggctaatcttttctgtatttttgtagagattaggtttcaccatgttggccaggctggtctcaaactcctgacctcaggtgatctgctcatctcggtcccccaaagttctgggattaaggcatgagtccctatacccagccattttttttcaattttttttgagccttagttgaactcacagatgcagaacccatggatacagaaggctaactgtctatctttacactgacat

SEQ ID NO: 14652 - DNA, 1377 bp, Homo sapiens
tttctttcctagagtctctgaagccacagatctcttaagaactttctgtctccaaaccgtggctgctcgataaatcagacagaacagttaatcctcaatttaagcctgatctaacccctagaaacaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttctt

SEQ ID NO: 14653 - DNA, 2528 bp, Homo sapiens
gctgccagctgagtttttttgctgctttgagtctcagttttctttctttcctagagtctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaa

SEQ ID NO: 14654 - DNA, 554 bp, Homo sapiens
cagtgcagacaggcttggctttgaacagcatccagctccacgattctatcagctaaattttttttttgtactttaagaaatagggatagtcatagtgtttactgtacgcagttgttctgaggagaaattaggaaaagagtctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaa

SEQ ID NO: 14655 - DNA, 1880 bp, Homo sapiens
gcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttacactaaa

SEQ ID NO: 14656 - DNA, 2769 bp, Homo sapiens
tttgctatgtgaataatgctgctatgaatatggacaaataaataatctgcttgagtctctgctttcacttctttttgggtataaaaccaaaagtggaattgctggatcaaatggtaattctatggttaatttttctgaggaattaccataccatttttcacagcacttgcccccttttacattcctactagcagtgcacatttctctagattctcaccaataattgttatatcctgctttttttttaaaataatagccaacctaacagacatgaagtggtatctcattgtggtttttatttgcatttcactaatgattagtgatattgagcatctttgcatatgtttattggccatttgtatattttcttttgggaaatgtctatttaagtcctttgcccatttcttaatcagttgtttgttttttgttgctgagttgtagaggttctttatctattctgtatattaatcccctatcaggtacaagatttgcaaatattttccttcattctgtgatttgtcttatcactctgttgatagtatccttccatgcataaaagtttttaattttggtggagtccagcttaattatttttactgttattgcctgtgattttggtatcatatctaatgaatcactgccaattgccaaatccaatgttacaaagctttttcctttcttctgagttttataattttagggcttacatttaggtctttcatccattttgagttaatttttgtatatggcataaagtaagggtccaactttaccctttttcatcatatatccagctttcccacacatttgttgaaaagaccatcctttccccattagatggtcttgtcattcttattgaaaatcattccaccattgttatggaatgaattgtgcacttcccacccacccctgcccaaaattcttaagttgaagccttaaccctcttatgttgaactgttgtttggagatagagtctaaaaagaggtaataaaggttaaataaaatcgtaagagtgaggccttaatccaacagagctggtgtccttagacaccaaagctcactctctctctctctgtgccactgaggaaaggccacttaaggatgcagcaagaaggagccatctgcaatccaggaagaaattccttgccaggaaccaaattggttgtcaccttcatctaggacttctagcctcgagaacttacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaat

SEQ ID NO: 14657 - DNA, 3489 bp, Homo sapiens
actttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagacgcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggcggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaagcagtgttctggttcatctggaattttgctgtactttaaatctttcagactcagctactgataaatgaaacgttacacaggtgtgaaccaaatccaaataacctcgactggtctactatcataatcacctgaacagaacaaaactttttcctcagctttaagagtccagggcttcggataacagctgccatctgccacctgctaccattgacctacgtgaacacagacattctgtctccaccttgatggtgggtgggctgctccccttttctttgttaaattttgtgctttcatcacattttctctattctgacctctgttatgagaaataaaagtcactgattccatttta

SEQ ID NO: 14658 - DNA, 1834 bp, Homo sapiens
gttaaaaccagactgcactccttctggctcctggttcattcaaggtctacatagttaaaggttgttccagagggatgtgtgtaattcctcccagtatttgatgttcctttattacttattttcacttgagccaacagcctgaactggtcaggctttgggctgatgccagctgctttatctggtagcactgttacataaaattaacatttattggtgatcactaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcag

SEQ ID NO: 14659 - DNA, 2290 bp, Homo sapiens
gctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaa

SEQ ID NO: 14660 - DNA, 429 bp, Homo sapiens
agttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcgg

SEQ ID NO: 14661 - DNA, 574 bp, Homo sapiens
agctgtaaatgggtcaggagaccagagtggacagagtaggccctggaatgcttgctcggaggcctgccatgaaggatttctgcttgcttccccaccctaccccgggggcaggatgactcagcacttcctattgttgtgaaggccaaccccaggaggccctaccaaggctgactgctgttaaaaccagactgcactccttctggctcctggttcattcaaggtctacatagttaaaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagc

SEQ ID NO: 14662 - DNA, 570 bp, Homo sapiens
atagctgccagctggaagccgactctcgtcatagggcatactcgccccactgtgcatcgccggtgcctacctcacccagttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagtt

SEQ ID NO: 14663 - DNA, 1597 bp, Homo sapiens
acaatgctgggacggtgcctggtctgaggatatttcttaccactgtgtttcagcttttcctcatctgaatcaaacatttgaattctttctagaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatg

SEQ ID NO: 14664 - DNA, 1114 bp, Homo sapiens
cccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaagtgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaagg

SEQ ID NO: 14665 - DNA, 2261 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctgctagccgccgtcgcctgcgcgctcaggcctctgggattagtagttttagcctcgtggatggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacag

SEQ ID NO: 14666 - DNA, 2109 bp, Homo sapiens
gtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaa

SEQ ID NO: 14667 - DNA, 1955 bp, Homo sapiens
atggcctggaactcgccttcccggcgacctgtttggcagggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacag

SEQ ID NO: 14668 - DNA, 2275 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctgctagccgccgtcgcctgcgcgctcaggcctctgggattagtagttttagcctcgtggatggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttc

SEQ ID NO: 14669 - DNA, 4697 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaatttta

SEQ ID NO: 14670 - DNA, 3717 bp, Homo sapiens
tgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaaatacagtggaagcagtttttgatttcattcagagaagcagaaggatgattgttgttctgagccctgactatgtgacagaaaagagcatcagcatgctggagtttaaactgggtgtcatgtgccagaactccattgccaccaagctcattgtggttgagtaccgtccccttgagcacccgcacccaggcattcttcagctcaaagagtctgtgtcttttgtgagctggaagggagaaaagtccaaacattctggctctaaattctggaaagctttgcggttggctcttcccctgagaagtctgagtgccagttctggctggaatgagagctgctcttcccagtctgacatcagtctggatcacgttcaaaggaggagaagtcgtttgaaagagcccccagaacttcagagctcagagagggctgcaggtagccctccagccccaggcacaatgtccaagcaccgagggaagtcctccgccacctgccgctgttgtgtcacctactgtgaaggagagaatcaccttaggaacaagagccgggcagagattcataaccagccccagtgggagacacacctctgtaagcctgttccccaagagtcagaaactcaatggatacaaaatggcaccagattggaaccccctgctccccagatctcagcccttgctcttcatcatttcacggacttatccaataacaacgacttttatatcctataattactgtgtgtggtgggtggtggctactatctctaccaaccctctgtatgtcatgaacctgtgggaaaatctgacatttttatcatctaatggactatcagatttctgtcccctttattgatttttaaaaactatttatttctaggagacaaaagacctgaaggacctgaatccagaattattgcctctaaaggcctcagaagagcacactcttcttgggccctagaaggtcagtatgtgaaagttgcctaaagtctgatcctctatcttgtccaatggtttaaaactgagctaagaatttaaatgtgtttcttttcagtgagttgatcaacctcacattataagtcagtcaggtgtacttgggctatgatgcttacagggtgtatgcattcccagggagcagcatggaaaggagctggttctggtggaagctgtaggacgaagctcaacagaaaacctacagcacatttttcctcaaagaaccaaacatacccacccagggatacatggcgttctctgtctcactgtaaactagtgttctctaaactgcctaacattgttagcatcaataaaattctatttttacgtcattttatttgtactaacaaatttttacatctctctcacccttctacttcctatgattgttgtattcttatctggagagtattccatttcagaaaatggagatttggtttaggtaccagaaaaactaagatgccttttttgtttctctctgatatgtaatgggagagatgtggaaaataaccaaaagagagggagaatgtgacttaaatgaaatggaagtttacaacaatctcatatttttagaactgacagatgaaaaattccgtattgtaagtgatgtagcgtagaaataggtgccttcgtcccattcaggcttctgagaagggataataaattcaagtgcctacaaggatcagaaggtaagagaaaagagaaaatatggccagataccagcttattttacatgctctccatctagaactgatgtgaatagggacataggcacagatagttatttcttctctgtaaacattttcataaactcatataaggcacatggcatttgatttccaagtcaggtagatcattggccctctaagcaactgaagaacacatatttcttaaaaagggtcagcttcaggccgggtgtggtggctcatgcctataatcccagcactttgggaagtcaagacttgtggatcaactgaggtcagttgttcaagagcagcctggccaacattgtgaaaccccatctctacaaaaatacaaaattagccaggtatggtggtgggcacctgtaatcccagctactcaggaggctgaggcaggagaaactcttgaacctaggaggtggaggttgcagtgagccgagatcgtgccactgcactccagacttggtgacagagcaagactccatctt

SEQ ID NO: 14671 - DNA, 4778 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggtgagtctcgcgccgccgtgagggctcagaagtcaccaagccgcagaatctcagggtagacggattcttagagatcttacaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaatttt

SEQ ID NO: 14672 - DNA, 2048 bp, Homo sapiens
agactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaa

SEQ ID NO: 14673 - DNA, 534 bp, Homo sapiens
ctcactggggaagactgccgggatccaggtctccggggtccgctttggccagaggcgcggaaggaagcagtgcccggcgacactgcacccatcccggctgcttttgctgcgccctctcagcttcccaagaaagtccttttgcagattgctcagcacaggacatgataattttcatctcggattttggaggaattgatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacc

SEQ ID NO: 14674 - DNA, 1957 bp, Homo sapiens
tgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaa

SEQ ID NO: 14675 - DNA, 2244 bp, Homo sapiens
aaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaagggctttgacctgaagcttgaaattgagtttgggacaataatgtgtctcatggggaattgcatggactccttatcataagccaaatgctgaggtaaagctgcggaattgagtcgtcctccaagaagggagagaaaatgatgtcttgtgacatttccagataactggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaata

SEQ ID NO: 14676 - DNA, 2234 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaaatacagtggaagcagtttttgatttcattcagagaagcagaaggatgattgttgttctgagccctgactatgtgacagaaaagagcatcagcatgctggagtttaaactgggtgtcatgtgccagaactccattgccaccaagctcattgtggttgagtaccgtccccttgagcacccgcacccaggcattcttcagctcaaagagtctgtgtcttttgtgagctggaagggagaaaagtccaaacattctggctctaaattctggaaagctttgcggttggctcttcccctgagaagtctgagtgccagttctggctggaatgagagctgctcttcccagtctgacatcagtctggatcacgttcaaaggaggagaagtcgtttgaaagagcccccagaacttcagagctcagagagggctgcaggtagccctccagccccaggcacaatgtccaagcaccgagggaagtcctccgccacctgccgctgttgtgtcacctactgtgaaggagagaatcaccttaggaacaagagccgggcagagattcataaccagccccagtgggagacacacctctgtaagcctgttccccaagagtcagaaactcaatggatacaaaatggcaccagattggaaccccctgctccccagatctcagcccttgctcttcatcatttcacggacttatccaataacaacgacttttatatcctataa

SEQ ID NO: 14677 - DNA, 4769 bp, Homo sapiens
aaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttg

SEQ ID NO: 14678 - DNA, 523 bp, Homo sapiens
agatatttcttgggtagtagaaaaagaaatacttcacagagctgtcaaatctccacatcttcagcattaaatatcatgcaaccaaatgatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactccca

SEQ ID NO: 14679 - DNA, 2091 bp, Homo sapiens
atgaaagctccgattccacacttgattctcttatacgctacttttactcagagtttgaaggttgtgaccaaaagaggctccgccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacagcccctctgactgataagccacccaagcttttgtatcctatggaaagtaaactgacaattcaggagacccagctgggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtga

SEQ ID NO: 14680 - DNA, 3667 bp, Homo sapiens
gagacaccttcccaaacagcaggggttgtgtgctttcacatagcagtactgtacaaggaaaaccccgtcggatctgttattgcgggatacttgtgaaatatacataggattctttcttatggctgcatcccggatctggaaattttacttggggaccaggaggatttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtggggaacggcctttaagagctggaagatgaaagctccgattccacacttgattctcttatacgctacttttactcagagtttgaaggttgtgaccaaaagaggctccgccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacagcccctctgactgataagccacccaagcttttgtatcctatggaaagtaaactgacaattcaggagacccagctgggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaa

SEQ ID NO: 14681 - DNA, 2061 bp, Homo sapiens
atgaagccaccatttcttttggcccttgtggtctgttctgtagtcagcacaaatctgaagatggtgtcaaagagaaattctgtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacagctttactcacagacaagcctcccaagccattgttccccatggagaatcagccaagtgttatagatgtccagctgggtaagcctctgaacatcccctgcaaagcattcttcggattcagtggagagtctgggccaatgatctactggatgaaaggagaaaagtttattgaagaactggcaggtcacattagagaaggtgaaataaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaaggatttaatctataaaattgagcttgcagggggcctgggagcaatcttcctcctccttgtactgctggtggtcatttacaaatgctacaacattgaattgatgctcttctacaggcagcactttggagctgatgaaactaatgatgacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtag

SEQ ID NO: 14682 - DNA, 2985 bp, Homo sapiens
gtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcagctgtcaagaaaagtgaaggatgaagccaccatttcttttggcccttgtggtctgttctgtagtcagcacaaatctgaagatggtgtcaaagagaaattctgtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacagctttactcacagacaagcctcccaagccattgttccccatggagaatcagccaagtgttatagatgtccagctgggtaagcctctgaacatcccctgcaaagcattcttcggattcagtggagagtctgggccaatgatctactggatgaaaggagaaaagtttattgaagaactggcaggtcacattagagaaggtgaaataaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaaggatttaatctataaaattgagcttgcagggggcctgggagcaatcttcctcctccttgtactgctggtggtcatttacaaatgctacaacattgaattgatgctcttctacaggcagcactttggagctgatgaaactaatgatgacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg

SEQ ID NO: 14683 - DNA, 1561 bp, Homo sapiens
gaggttttcttggctgtctacataaggctgaagtgcattatttaaactgtagcatccgtgtcactgctggctcactagctggtatcctagagcttttgggacatctgacatggtggctttgagagctgtcttcctgctctggccagccaccataagctcttcacctttagttcatcttaaagggacacgaatgaaaccagaagcattcattttttcaacgaatggtgtgcttctagaatgcgagacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggggaaagaaggacctgcttttgtagtatggcaccttgttccaatgtacagttttgatttcttcctgaaaacaaaaattttaaaatcctgttgtcttagagtagcttttatgatagcacatggactgcatgcttagtaggtgagctgtcttgcccatatttaaaaagatttcagtattcacatggtatttgaaataaagaaaatttaaagactttaattgaatttgaaaattctgaaccaagtttaagggaaaaaatgacttctatagagttctgaaaactca

SEQ ID NO: 14684 - DNA, 1578 bp, Homo sapiens
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaactccgtacgtcttctcttatggaagtggctgtgtctttttgagggactctgttctttgcctcagttgtctaccaaaggtgccacatttatagtggctttgtagtaaaggactaaagtctta

SEQ ID NO: 14685 - DNA, 1405 bp, Homo sapiens
gtgggatgggagatactgttgtggtcacctctggaaaatacattctgctactcttaaaaactagtgacgctcatacaaatcaacagaaagagcttctgaaggaagactttaaagctgcttctgccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaa

SEQ ID NO: 14686 - DNA, 792 bp, Homo sapiens
gactcagagatgagacagttgcctaaaaacttctgggaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaaga

SEQ ID NO: 14687 - DNA, 2058 bp, Homo sapiens
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctc

SEQ ID NO: 14688 - DNA, 3994 bp, Homo sapiens
gtacatgatgcaccagcatttttgaacaagtcatagatttggccacaaatcaaatttcaggatgggaggagtgtctcccctttaaaatagaagagagtgagtagtctatgaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgcta

SEQ ID NO: 14689 - DNA, 1051 bp, Homo sapiens
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggtttggtgtcagagtttctgcaaattaaaaaagagcttaatctttagtaatactcattggattcaaagtctaatgagaggctttgtgatggtatactatggtgtacataaatgttgtcgagtggtttttaatctttgtttgcaatactttcaacatcatcaatggccttga

SEQ ID NO: 14690 - DNA, 898 bp, Homo sapiens
gagttgtgaaactgtgggcagaaagttgaggaagaaagaactcaagtacaacccaatgagggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttc

SEQ ID NO: 14691 - DNA, 2693 bp, Homo sapiens
aggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactga

SEQ ID NO: 14692 - DNA, 545 bp, Homo sapiens
gtgaaactgtgggcagaaagttgaggaagaaagaactcaagtacaacccaatgagggcataaggaaatcggaggcatgtttctgtctggctataacagttctcctactagatcctgaggccaaactattcacatgccattgttcctgaataccattgtggacataatcatctaattttggctattccatgcagagatatgctgctgtgactgctgacttgaatgttacgggatccccagcaggatctgggattctctctgttcttgaatgcgttgtttagttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagaca

SEQ ID NO: 14693 - DNA, 2615 bp, Homo sapiens
cccgcccacggtggcggggaaatacctaggcatggaagtggcatgacagggctcgtgtccctgtcatattttccactctccacgaggtcctgcgcgcttcaatcctgcaggcagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctagacacccagttgagctcaggcgtagagaagaggaggatgggataagaactggggccatccccatgtcatggtgggtgagagctggggccatccccgtggtcatggagggtgagagctgggggttatccccatggtcatggagggtgagggctggtcgggggaggcatccccaagtcatggtgggtgagagctcggagcatccccatgtcatggtgggtgagatctgggggtatccctgtgtcatggtgggtgagggcgggtggtcatccacatggtcatagtgggtgagagctgggggtatccctacatcatggtgggtgagagctgggagcatccccatgtcatggtgggcgagatctggggggtatccccacgtcatggtggatgagagctgggggaatcaccatgtcatggtgggtgagatcttgggggatcacctgtcatggtgggtgagagctggggggatcacctgtcatggtgggtgagagttgggattcatccccatgtcatggtgggctgagcccacatggaagcctgtgcttggacagcgtatgcccttttctctgtttttccacaatgaacaattaaactgtaaatgttaaaaatatcagtaatttgtgaaataaattttattctcatttgagcaacataaa

SEQ ID NO: 14694 - DNA, 557 bp, Homo sapiens
ctttctcctttcccgctggcccttgccagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcgg

SEQ ID NO: 14695 - DNA, 1480 bp, Homo sapiens
ggaagtggcatgacagggctcgtgtccctgtcatattttccactctccacgaggtcctgcgcgcttcaatcctgcagcccggtttggggatgtggtccttgctgctctgcgggttgtccatcgcccttccactgtctgtcacagcaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattaaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctaggg

SEQ ID NO: 14696 - DNA, 1769 bp, Homo sapiens
ctttctcctttcccgctggcccttgccagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaa

SEQ ID NO: 14697 - DNA, 3695 bp, Homo sapiens
gacgtcagccctgcggggcgctggcggagcgggcggcggagctgtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 14698 - DNA, 2239 bp, Homo sapiens
agcccaagggtagctggaggcgcgcaggccggctccgctccggccccggacgatgcggcgcgcccaggatgctgccgtgcctcgtagtgctgctggcggcgctcctcagcctccgtcttggctcagacgctcatggtaaggctccgggacgcggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcagggcccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtca

SEQ ID NO: 14699 - DNA, 2275 bp, Homo sapiens
agtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcag

SEQ ID NO: 14700 - DNA, 1779 bp, Homo sapiens
agtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgca

SEQ ID NO: 14701 - DNA, 1723 bp, Homo sapiens
gggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttgga

SEQ ID NO: 14702 - DNA, 1453 bp, Homo sapiens
gggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggtaagtgactgccattggtccctcagcctctgatcctcacacatgctctgatgcccatagaccacattcatctccacccttcatgactgcccgctgaacctgtctgattctggaactacctccccatacctccatcccccatgccccacttgattttaactgattcctctcctgaccctttactaataaaccctttggcggagactgagataacccaca

SEQ ID NO: 14703 - DNA, 1700 bp, Homo sapiens
gagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttgga

SEQ ID NO: 14704 - DNA, 3008 bp, Homo sapiens
atctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaaggggcgggtagggagtgtgtagggagcgtgtacgtggctttgtgtccttggctcctccagactctcacatgtgcgggcaccatatacttctgctgcccttgtgccccaatcattgcacaaacagaaacagctctgacagagaagggactgctagagttaggaaccctagggcctggaaggaaggtatggctctcagagtgacctggggtctattcagtcccctctggacctgtttccctggcaacgctgtgggaacaacagtctatgcaacacaggagacctgatgccactggtgtcctccaaattttaaggcgaaggcaggcattgtgaatgatgcagggatggccagaatggtttttgccttcgttctttccccaggggaaccaagcctgtgggtggggaaatcacactaaggctggacagtgactgaatctggcccaggagaaacttggctgcctgccttccagaccagggtttttcttccctgagatcctggaggggaagtacctggaacttgggagtgttgccctggtctggaagatctgatagacatagtatgcacacatttccctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagtt

SEQ ID NO: 14705 - DNA, 944 bp, Homo sapiens
gtgatttctaacagccttaccccacttggtgcatcaatttttctcctaggaagcctcagttttggagaggaagagccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacg

SEQ ID NO: 14706 - DNA, 537 bp, Homo sapiens
aaagcactgggtatacagtgggaaaggggacctcagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccc

SEQ ID NO: 14707 - DNA, 575 bp, Homo sapiens
agagggggcggggcagggaaggggaaggaggggatggctctggggtcccagaactgagtggagtaggagacgggggctgtagctggtgagaggaagtcctagaggctatggacactctgctgctgggatcaccgaggtagggtggggctaagcaggatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggttt

SEQ ID NO: 14708 - DNA, 2906 bp, Homo sapiens
gactgggtcaggcgcctccttcacttgctgtgagtcccttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttggtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattca

SEQ ID NO: 14709 - DNA, 1856 bp, Homo sapiens
ggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccttggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagccactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctctctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatcccc

SEQ ID NO: 14710 - DNA, 2100 bp, Homo sapiens
ggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagc

SEQ ID NO: 14711 - DNA, 4040 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 14712 - DNA, 3940 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaagagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 14713 - DNA, 687 bp, Homo sapiens
acagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaaggtgagttttaagcgtcaacttaaaactcaagggaataaaactgaagg

SEQ ID NO: 14714 - DNA, 2454 bp, Homo sapiens
agagagcgcggagagcgcgacacgtgcggcccagagcaccggggccacccggtccccgcaggcccgggaccgcgcccgctggcaggcgacacgtggtcacggtgatccatttgtaaagtcgggaataaatgacctctgaagtgttgtctgtatattgatctgctaccagtaaaacatatctctgaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaagagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagc

SEQ ID NO: 14715 - DNA, 2439 bp, Homo sapiens
gcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaa

SEQ ID NO: 14716 - DNA, 1797 bp, Homo sapiens
gtatttaaaactagttaagatcttctgatttacctgagcgggtggggaaacccaccccatgagcatcccctgggctcacccagtgcacagagggaggcctcccgtggctgggcccctctcagtcagcccatgtggctgccatgacctggagcaccacagccgggggcgcccaccagctcaacaccaccacattcacgtggcagcacctccctgcctggcaaccgctgctgttggccagcattaggctgcagctcttcttctacgtgggcctggccttcatcagcctggacctctattactcctccaccagcatcaaggagctggagtacaactacaccggcgacccgggcaccagcaactgctcggtgtgtgctgtggctggccagggctgtgtgccactgcccatctgctcatgcgcctggtacttctcactgcctgagctcttccagggccctgtgtacccctactacgtgctgaccaacttctaccaaaacaaccggcggtatggagtgtccgcgacaacgcgcagctgagcgggctgcccagcacgctgcaccatccagtcaatgagtgcacccactgcgccgcctgcccatcgtgcaccctgcaatgtcatcaccaacagcctcttcaacgactcctcgctgtggcaccagtgctggcccggcgagccctacgtggaggtgccgcgctaccgcactgcacctgcatcacccggtagaccaactaccccatcaagttctgcaacccaccactggtcaacggcagcctggcactggccttccatggcacagcacccctgcccaactggcgctggctggtctacgacaagctcagccccatccccaacaacaacggcttcatcaaccaggacttcgtggtgtggatgcgcatggcagcgctgcccacgttccgcaagctgttccgcaagctgtacgggcacatccgccagggcaactactcagctgggctgccgcggtgtgtctactgtgtcaacatcacctacaactacctggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtc

SEQ ID NO: 14717 - DNA, 1096 bp, Homo sapiens
ggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcct

SEQ ID NO: 14718 - DNA, 4036 bp, Homo sapiens
agagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaa

SEQ ID NO: 14719 - DNA, 1371 bp, Homo sapiens
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttg

SEQ ID NO: 14720 - DNA, 1498 bp, Homo sapiens
taaaaatttgatcctaagattctataaagtagccattgaggcttaccaaagttacaatattacagatggatcaggggagacggttgctatggagatggatgatatcataactccattgtgaaccagtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaa

SEQ ID NO: 14721 - DNA, 588 bp, Homo sapiens
tgtggagctgccgccatggccccgcggcgggcgcgcggctgccggaccctcggtctcccggcgctgctactgctgctgctgctccggccgccggcgacgcgggagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttgatttgagggcaaccccctcctcttttcaaaacctatgaaccacctgctttgcaggcaaactcccccgctggccagcgttgaaatggaagccatggaggctctgccggtg

SEQ ID NO: 14722 - DNA, 1626 bp, Homo sapiens
tggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 14723 - DNA, 839 bp, Homo sapiens
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagtggtgctgttcttagctattcaggatga

SEQ ID NO: 14724 - DNA, 1646 bp, Homo sapiens
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgc

SEQ ID NO: 14725 - DNA, 584 bp, Homo sapiens
agtccagcggtgtcctgtggagctgccgccatggccccgcggcgggcgcgcggctgccggaccctcggtctcccggcgctgctactgctgctgctgctccggccgccggcgacgcgggagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcct

SEQ ID NO: 14726 - DNA, 1333 bp, Homo sapiens
atggccccgcggcgggcgcgcggctgccggaccctcggtctcccggcgctgctactgctgctgctgctccggccgccggcgacgcggggagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 14727 - DNA, 759 bp, Homo sapiens
atggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttga

SEQ ID NO: 14728 - DNA, 564 bp, Homo sapiens
atggccccgcggcgggcgcgcggctgccggaccctcggtctcccggcgctgctactgctgctgctgctccggccgccggcgacgcggggagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttga

SEQ ID NO: 14729 - DNA, 1037 bp, Homo sapiens
agtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctg

SEQ ID NO: 14730 - DNA, 660 bp, Homo sapiens
atggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttga

SEQ ID NO: 14731 - DNA, 8607 bp, Homo sapiens
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaaagatggtcacgcgggatgtaaacgctgaatgggccaggtgcagtggctcatgcttgtaatcccagcactttgggaaggcgaggcaggtggattgcttgagctcaggagttcaagaccagcctgggcgacatagtgagacctcatctctacctaaatttttttttagtcagtcatggtggcacatgcctgtagtcccagctactcgggaggctgatgccagatgatcacttgagcccaggaggtagaggctgcagtgagctataatggtaccattgcaatccagcctgggcagcagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacaggtgccctccacgctgtgcccctcccacctcttcagctcgtctcctgagtgtgcagaggtggttccggttgggaaagaagcagcggagcatctaaccatgcctgtgtccaggccgattatgcacgcagccaccaacaagctcccaactcccgcgtagagtttcatgactttttcctgcctactatcttgatcctagttttttttttgttttttttttttttaaggaataattactttgattcaaaaccagtttctcttttctgcataggaaggtccttgaaggtgtttagggtctaaaaagggtggtgttcggtctctgaaacatccattcagcagtttgagctgggatctctgaatgcaagggtatgatggatatacttctttcttgcttttgttgtgttttggttttttgtttgtttttaagtcagggtctctctgtcaccaggctgtattacagtggtgcaatcatggctcactgcagcctcgacctcccaggctcaagccatctttccacctcagcctgccagtggctagaactacaggcgtgcaccactgtgcccggctaatttgtgtgtatatattttgtagaaatggggtttcaccatgttgtccaggctggtcacgaactcctgggctcaagccatctgcccgcctcatcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgcttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacgcctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaaccca

SEQ ID NO: 14732 - DNA, 2693 bp, Homo sapiens
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggct

SEQ ID NO: 14733 - DNA, 2010 bp, Homo sapiens
ggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctacatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccactttta

SEQ ID NO: 14734 - DNA, 2621 bp, Homo sapiens
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccggtgagtctggaaccctggggagacgaggaaaggctcagggttcagtttttggctcagcaaagccttagcctggctcctgtcactgctgccactgccagaactgccctgtctggtctgtctggtgctgatggtagaagagaagaacggggaaggggcaagagctgggtctgtctttctctgggagggtctgggaatacggagccccagaaaaagggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccc

SEQ ID NO: 14735 - DNA, 2384 bp, Homo sapiens
acagccagcagcctgccgggagccaaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttcta

SEQ ID NO: 14736 - DNA, 2388 bp, Homo sapiens
ggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccca

SEQ ID NO: 14737 - DNA, 2108 bp, Homo sapiens
agagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccc

SEQ ID NO: 14738 - DNA, 2147 bp, Homo sapiens
atgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttct

SEQ ID NO: 14739 - DNA, 2284 bp, Homo sapiens
aggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttcta

SEQ ID NO: 14740 - DNA, 2244 bp, Homo sapiens
aactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttcta

SEQ ID NO: 14741 - DNA, 8720 bp, Homo sapiens
gcggccgccgcggccaccgcccactcggggctggccagcggcgggcggccggggcgcagagaacggcctggctgggcgagcgcacggccatggccccgtggctgcagctctgctccgtcttctttacggtcaacgcctgcctcaacggctcgcagctggctgtggccgctggcgggtccggccgcgcgcggggcgccgacacctgtggctggaggggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtccaacttcctagttttgtttaattagtttcactttttctactctccccagtatgctagaaatgggaatcgttgccctgcagattacggcaaaacatctgttttaagcaaagctgcattttttgactcagaaattgtcccagacggtggatataagatgaaattcagaaaaacgttctgccaagtcacaggcttttagatattatggaaacaagaaatggaaaacaggatgatctccatgagaggccttgatcctgagagtaaaaggcttgtgtagataggttagacaacgtcctctagaaaagagaccagggataagtccaggtttccaggaaaaccaagaagcctgcgggtagctgaaggtagagtgctagttgttcatcttaacttaccaatgagctacagaaaggacttagcatctgatgtcatcagctttgccaggagagtgatcaaggaggttaaagctcaggtaaaggtgtgccttctcagagattggctacaagcaacagagaccacctcaacagagaccacctcaacagactcagcccagccatacaaggtgccaaagctcctccagagggctgtcttgggcctttgaggcaattgatctccagaaagagtcagaagtcattccagtccaggcccaggtattcagatggtgacccagccagataatagtatcttgagcaaataatagtatcttgagtgcaaataagcaggaagactgtccttcaaaaaatgtggggttacatgattttcagagcctttttttcagagttgagcatcttttcttttaaaagaaataaggggcaagaggaccaattttattccttgaggaaaaatgacacacccttctcccaaaagaaagaaaactctctggccccccaacttcaacactaatttggctccctgaagaagagagaaaatattatttctgtctttattgaagagaaatgggcaatgccaatgtgaaggttactagtcttttttattttctattggtgaagactactactgctcttatttagcagatcttataccttcagtggtcaccagtatagcaggtgaggtataaggaaaacagcagtgtgatgataaatggtaattaatatactttgtctgtgtcagcaatagggaatggtggggactgtggcaaactgaagcgcccctgttccacccacagtgggtaattttccagtcgactgtggccatgaagtacttcctgatcttcccatttttcaagaaaagctgacaatctggatttttatatgaaaaattctgattttaaaaaatattggcaactaagttaaaattcaagtgaatttagacccagcagaagacatggatggacctgatttggtccactgactaccagtttgttaacctgtgctttataagatttgaaggaaaggcattcatggtaattacagacggtgccaccagaaaatgctcttgctaaatgcagccagtagttagattgcttctttctccagtctcccccgcaaagaaatttgacgtgattctgaatgcactggacatgtcttgattgcgtctttacatttcacagtgtcttaaaagaaaggcaagccagttgttaatttcagaatcagatttatgctctctcaatttaaaaaatgctgggaacaatttcatttttttttttttgagatggagtcttgctctgttgcccaggctggagtgcagtggcgtgatctcggctcactgcaagctccacctcccgggttcacgccattctcctgcctcagcctcctgagtagctgggactacaggcgcccaccaccacgcctggctaatttttttgtatttttagtagagacggggtttcactgtgttagccaggatgatctcgatctcctgacctggtgatccgcttgcctcggcctcccaaagtgctgggattacaggcgtgagccactgcgcccggcctaacaatttcatttaaactccacaacctaaagggctttgtttatagttttagctcttggcataatttttttcaggtggtgtgcaattctgagcataggccaagacatgattaggaaagcaggcagttgtagagagtaaggcaaggaacctcctagcgtccattagagccaggtatttgcattatcttccgttttaagtggtctgtgaattgactgtgttttggaggtgtgaaacagtatacagagaaaagcttttcctgatactgagatatcagttaggagtccaaatggggtgttgggtcatccttgccatatcacctcctttccaggctcagagtgaaaatagacaaaaggaaatctgactgcaagccagtggctttgattccagtttcagagtttagggactaggagagagtttagattatctagcatattctccccctggtgtcagacagggctgtgcctgaattattccagacatatggctgtagatggtattctttattttataagaaggagattctgtaacctaccctgctgatcagatagttctttgtatgtcttagagaaattcaagccagcttccttttgttcggcttgtagtggagaaagaacagctggtcaccttccatgtattcaaaaaccacagtgaagtcatccccctggtgtttttatttcagtgataaataattccacccacttaaaccattcttcatggctcttgttttccaggggcctaataattttcactgctgtaatgtttctcagcttcacacttagtttagttgcccaaacaatgttggtgccttactcacattggtgccttgtgaagacgaggctcaggatggggattatggggaaattcttgcacacccagctcctcttaccacttaaaaatataatggcactttcacaaaatgatatgtcacctatattcattgagaattatttgactgccacatttttcccctgatgatagtcatctatcataacttgtgtttgttttcctcctgagatcaaacacttggtgcttattcctgatgtatactctgagaccagctcttaccttctgagtggcagctacccctccctcccaattttagatcctatttttacacatctctatagatatcacctttatttcatgactcacaatattaaatggtacagacttcagtttaaccactggtgtggtaacagcagtagttgctaagtaccaccttcccattgctgtttgagggctaatttgcaaagacatttgaatctcccagtgaagatgtctggggaattttggccagttgtcttccctcttgcccttttgttctttaaaattcagcttggaccatagacacctccaggatcttgtttatgttctgctctcaattgaccaagcactgcgttttgcacaatcagaagtctcacaaaagcaaacagttatgactgcatatctgatgtttatatcctataaaatttcaggaagattcagagtcaatcttctatttgtacatgatgtagacaaaattagctgctccaattgttagacaaaaaattgccattggattacactaatgtgctcatctgttgttttaaaagtttggtatcaggcggggcacggtggctcacgcctgtaatcccagcattttgggaggccaaggtgggcggatcacctgaggtccagagttcaagaccagcctgaccaacatggtgaaaccctgtctctactaaaaatacaaaattaatcaggcgtggttgtgtgtgcctgtaatcccagctactcgagaggctgaggcaggagaatcgcttgaatccgggaggcagaggttgcagtgagctgagatcacgccattgcactctagcctgggcaacaagagcgaaactccgtctcaacaacaacaacaaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgtgggatctagtgggataatgagcactgacagaactcttaacagcgtgctgtatttttgacattgaaaatgttaatgacttgatttgtacataactctgtaactaggtgaaagtagatcacagctgacatttacaaaatgtttttgtaccttagaatttctgcattaaataaaatgttttgttttaa

SEQ ID NO: 14742 - DNA, 4474 bp, Homo sapiens
atccgctcttcttttcctccgggaaaagaaacgggaagtggccgtgggccggtgaattccgtgtagtggccaagctttgttccaaagagggggaggtggtgacagtctcttgcccactgaagcgtgccagacagagtgctaggcatgggggcagaggtgaatcagatgacagccacctctcaccacgaggagtggctgaaagtgtgactggactacaggcaatcctggccttggcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtcc

SEQ ID NO: 14743 - DNA, 4291 bp, Homo sapiens
atgccacgcgcttctgcctcaggtgttcctgcgttgtttgtcagtggagagcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtcc

SEQ ID NO: 14744 - DNA, 2348 bp, Homo sapiens
gcctcaggtgttcctgcgttgtttgtcagtggagagcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaa

SEQ ID NO: 14745 - DNA, 589 bp, Homo sapiens
ttttcctccgggaaaagaaacgggaagtggccgtgggccggtgaattccgtgtagtggccaagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtcct

SEQ ID NO: 14746 - DNA, 3522 bp, Homo sapiens
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 14747 - DNA, 513 bp, Homo sapiens
atgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagataggaccacctatttgcaggaaaacaagctcagggctccactga

SEQ ID NO: 14748 - DNA, 3854 bp, Homo sapiens
acgcggggcgtctgggtggaggagccggtcctggagcacggctgcgaggagcacccggaccggagggtccccagaccgggacctccgagtcagggaggattctacgccagggagcgccccagactgagagcgccccagaccgctacactcccggacccggagcttcgcccgaccgcgggcagtgcccacctgcagcctccaccggccgggtcaggaggcggagatcgctgcttctcacctactttctgaacttggcctccgcagtcgcgacctggcgtgaaggaggagctgccgcccccgccccagcctcggggacgcctctctgaagagaagccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 14749 - DNA, 1749 bp, Homo sapiens
aaagctataaagctgtaagagaaattggctttctgagttgtgaaactgtgggcagaaagttgaggaagaaagaactcaagtacaacccaatgaggagaagccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaa

SEQ ID NO: 14750 - DNA, 2773 bp, Homo sapiens
acaatgtccatggtcatttacaaaataaggttttcctttttcctccagttataatcctttatttttgagctggtgtaacgtggctattgtgtcttctccaggtatctctctggataggaagaaatatagtagaaccctttgaaaatggatattttcacatattttcgttcagatacaaaagctggcagttactgaaataaggacttgaagttccttcctcttttttttatgtcttaagagcaggaaataaagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggagtgggattgagactgtggtttagagcctttgatttcctggactggactgacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaa

SEQ ID NO: 14751 - DNA, 1890 bp, Homo sapiens
cgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggagtgggattgagactgtggtttagagcctttgatttcctggactggactgacggcgagt

SEQ ID NO: 14752 - DNA, 587 bp, Homo sapiens
tctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttatt

SEQ ID NO: 14753 - DNA, 1473 bp, Homo sapiens
gctggagtgcaatggtgaaattatagcagactgcagtcttcaactcctgacctcaagcaattgtcctgcctcctcaacttcctgactacaggtgtgcatgaggactacaggcaggcatgtgccaacacatgcagctttttttttttttttttttcagagatgtggtctcgctttgttgcctacactggtctcaaactcttggcctcaagggatcctcccacctcggcttcccaaagtgcagagattacagtctcattttctctctctctgcattaatcaagaatgagagaaccctccaggggacaagatgaaggggaaatagatgatgtgcaaagaaatccttgctttatgaggggaaaaagtgttcctcatgaagttcaacaaaatgatgcaggtaaagcagttagctagcacctggcacatggcagacactcatagctgcctaaggcattggagaactggatcgtgctgcagccagaggcacctgcagagcctcatgggctggctgctgcagggtgtggctgattgagagtgcttttgtgagttggcctgcagggtacacttggtaacgtgccacagctctcaggaaagtgacctaagttggatttttctgcatggacatagaattgcaaaaaattctcatttgcatggagatggggagtttatttttcctagaagctgcatgtcaagacccagaagaaagaggcatttcataataatgattaatcagctatatcttaaagaagaaagaaaacaattaaggaaatacaatactaagaaaacaaggggaaaaaacaatctccccaaggtggatccacccagcaaaccttgacagcatttcctcttatccacctgaataaaaatgaccagccctttccaaatggcagagagcactgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttga

SEQ ID NO: 14754 - DNA, 1030 bp, Homo sapiens
tgcacacactgacaggagtccaagaatgtgcactgagggagcgtttccgcacagatctgcgtgttccttaccactcacacatgtgcacacacatatccatgtgtgtgtgccagtgctttggggctctgttccacggggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatg

SEQ ID NO: 14755 - DNA, 1006 bp, Homo sapiens
aagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatc

SEQ ID NO: 14756 - DNA, 1562 bp, Homo sapiens
agagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctt

SEQ ID NO: 14757 - DNA, 3176 bp, Homo sapiens
aactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaaaaa

SEQ ID NO: 14758 - DNA, 2928 bp, Homo sapiens
ggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatatttttt

SEQ ID NO: 14759 - DNA, 326 bp, Homo sapiens
agatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccagattttcaaatacagacagaaatggctgcaaccatggagacgtccata

SEQ ID NO: 14760 - DNA, 4113 bp, Homo sapiens
aggccttgcccctctatcctctgcacaggaagtgggctggctctgggcttttagtctttgcggccccagcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaa

SEQ ID NO: 14761 - DNA, 569 bp, Homo sapiens
acttcgctctcctgccagcatgtgaaggtgccttgcttccccttcgccttccaccacgattgtaagtttcctgaggcctccccagccatgtggaaccggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccaca

SEQ ID NO: 14762 - DNA, 587 bp, Homo sapiens
acttcgctctcctgccagcatgtgaaggtgccttgcttccccttcgccttccaccacgattgtaagtttcctgaggcctccccagccatgtggaaccgacccgcaaatcaggcttggagaagcttggagaagcttggagaggcttggagaattgctgcatcctggacacgatgttccgacaccaccctcgccagcctccaggtcttggagttgaggcttctgattggggaagcctaatcacacgcacacacttcaggactgaggtctggagctgaggcttctgattggggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgat

SEQ ID NO: 14763 - DNA, 660 bp, Homo sapiens
acttcgctctcctgccagcatgtgaaggtgccttgcttccccttcgccttccaccacgattggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaa

SEQ ID NO: 14764 - DNA, 297 bp, Homo sapiens
atggagccacccaatccactgggggagcaatacttcaaaaggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctga

SEQ ID NO: 14765 - DNA, 1933 bp, Homo sapiens
gtagtgggtgagggacccaggttcctgacacagacagactacacccagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctgggaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggtgagatttggagaagcccagaaaaatgaggggaacggtagctgacaatagcagaggagggttttgcagggtctttaggagtaaaggatgagacagtaagtaatgagagattacccaagagggtttggtgatggaaggaagccacaggcacagagaacacagaatcactttatttcatatgggacaactgggagaagggtgataaaaaagctttaacctatgtgctcctgctccctctttctcccctgtcaggacgatgccccgaattcccaccctgaagaacctagaggatcttgttactgaataccacgggaacttttcggtgagaacgctgtcataagcatgctgcagtctatcaactgccaactgcctgccagcaagacagacagagtgtgggggtgggggcagagaggagagggaaggaggccctgcactaactgtcaggatgtggccgaccaaatggggcatggactatacagagagagacacacacagaagtgcagattatagattgaatgaggcagatggcaactggtattgggggcccaggagcctgtgtatcccttctgtaatcaattacagtggttgcagacatcatgagtactcctttggcacagagctcggtcttttacttcctgcccctaattgacccctgacctggacatatctgtctttaggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctccctctttccctcccttcctctttccatctaccctccgattgttcctgaaccgatgagaaataaagtttctgttgataatcatc

SEQ ID NO: 14766 - DNA, 1534 bp, Homo sapiens
agaggaaacgtgtgggtggggaggggtagtgggtgagggacccaggttcctgacacagacagactacacccagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaaa

SEQ ID NO: 14767 - DNA, 540 bp, Homo sapiens
atgggaatgaagacaccacagctggaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctga

SEQ ID NO: 14768 - DNA, 3485 bp, Homo sapiens
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcgcatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 14769 - DNA, 1244 bp, Homo sapiens
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacggtaagcctgaaatggaatggggcatacattcatgtaccactctgtagctaatgtgggaacaaacaaccctgatgcattgattctctgcatgtgaatctgggaagtcatgatgttcaaaagatacgccgcacaaaataaagttctatatacagaaattttacagaactaacttcagatcttctttacagaaactctgttgacaggatatggtgttgttattggagtgtagagagattgtacacttcactttgatgaagagctttcacttgcacagtctttctctgagaagaagaaaaaaatgtgagcaaggacccaggacaatgaataagaactctatccatgtgttgtttagaattgttctcagcattggtccagttcctgaccatgctctgctgagctaaaggaaaagagtatattgaaactgttgct

SEQ ID NO: 14770 - DNA, 3503 bp, Homo sapiens
gaccatcagaccggcctgaataccagaatctctttgcaatgcactcgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcgcatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 14771 - DNA, 2023 bp, Homo sapiens
agtcccaggttcccgccaccaccgccgcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaattccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagac

SEQ ID NO: 14772 - DNA, 3162 bp, Homo sapiens
ccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaata

SEQ ID NO: 14773 - DNA, 4495 bp, Homo sapiens
ctagaggcagctcagatagaggagctctttgggaagagacgccgggcaggcagaagcagcaggtaccccctccacatccctagggctctgtgatgtaggcagaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagc

SEQ ID NO: 14774 - DNA, 3263 bp, Homo sapiens
ggtagagtgattttccctcggtgactcaactgggacgtagcaggtcgggcagtcaagccaggtgaccccatgagctgtcgctgcatctttctcatgaagcacggggaacgggtcggatggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccg

SEQ ID NO: 14775 - DNA, 2886 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatcatgttctcatgcagcatgaaaagctctcaccagaagccaagtggatgctggcagcacatttcttgtaacttcccaggctgcagaacattggctaaatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctt

SEQ ID NO: 14776 - DNA, 2620 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaagagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctt

SEQ ID NO: 14777 - DNA, 2790 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctt

SEQ ID NO: 14778 - DNA, 4549 bp, Homo sapiens
cggcaggaaggccatggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatgctgctgctgcctttgcaaggactactgggcttcccaagaaactcaagagcctccgtacctcccctgggcggcggaggggcattgcacttccgggaagtccacctagcggctgtttgcctgtcgggctgagcaacaagatgcccctccctcctgtgacccgccctctttaggctgagctataagaggggtggacacagggtgggctgaggtcagaggttggtggggtgtcatcacccccattgtccctagggtgacaggccagggggaaaaattatccccggacaacatgaaacaggtgaggtcaggtcactgcggacatcaagggcggacaccaccaaggggccctctggaacttgagaccactggaggcacacctgctatacctcatgcctttcccagcagccactgaactcccccatcccagggctcagcctcctgattcatgggtcccctagttaggcccagataaaaatccagttggctgagggttttggatgggaagggaagggtggctgtcctcaaatcctggtctttggagtcatggcactgtacggttttagtgtcagacagaccggggttcaaatcccagctctgctgttcactggttgtatgatcttggggaagacatcttccttctctgcctcggcttcctcatctgcagctacgcctgggtgtggtgagggttctaggggatctcagatgtgtgtagcacggagcctgctgtgtcctgggtgctctctacgtggtggccggtagaattctccatctatccaggctccaggagacccctgggcatctcccacctgtggcccctaaacccagagtgactgagagcacttaacattcagcttgtctcatccccagtctacctccttccttctaccctcactgcctcccagtcaggagagtgagctctcagaagccagagccccacccaaggggaccctggtctctccgccttcacctagcaatgggaaccctgcttcccaggggaggaaccaactgctccaccttctagggacccagtttgttggagtaggacagtaacatggcaggaatcggacttctgggcctgtaatcccagtttggatggcacgttagactcttggttgaccgttgtggtccttagaagtcccattctcccttccagttatgagaaaccaatgccttctagattcaggtgactatccttacctgggggtgctgatgcatcctcagttaacctacacccacctgaatatagatgagcgtagctgagttttcacccgtaggaccgaagtgttttgtggtggagtatctgaacaaccttggctctgtggccattcaacctgccaggactaacatttctggatttgtgaagaagggatcttcaaagccattgaacccacagagctgtgttgctttaaagccaccacaagggtacagcattaaatggcagaactggaaaagcttcttagggcatctcatccagggattctcaaaccatgtcccccagaggccttgggctgcagttgcagggggcgccatggggctataggagcctcccactttcaccagagcagcctcactgtgccctgattcacacactgtggctttccacgtgaggttttgtttagagggatccactactcaagaaaaagttagcaaaccactccttttgttgcaaaggagctgaggtcaagggtggcaaaggcacttgtccaaggtcgcccagcagtgctgctctgatgacttgtgcacatccccaagggtaagagcttcgatctctgcacagccgggccaacctctgaccccttgtccatgtcagtaaaatatgaaggtcacagccaggatttctaagggtcaggaggccttcaccgctgctggggcacacacacacacatgcatacacacatacgacacacacctgtgtctccccaggggttttccctgcagtgaggcttgtccagatgattgagcccaggagaggaagaacaaacaaactacggagctggggagggctgtggcttggggccagctcccagggaaattcccagacctgtaccgatgttctctctggcaccagccgagctgcttcgtggaggtaacttcaaaaaagtaaaagctatcatcagcatcatcttagacttgtatgaaataaccactccgtttctattcttaaaccttaccatttttgttttgttttgtttttttgagtcggagttttgttctttttgcctaggctggagtgcagtggtacaatctcggctcactgcaacctccacctcccgggttcaagtgattctcctgcctcagcctcccaagtagctgggattacaggcacccgccaccacacctggctaatttttttgtatttttagtagagacggggtttcaccatgttggccaggctggtctcgaactcctgacctcaggtgatccgcccgcctcggcctcccaaagtgctgggattacaggcgtgagccaccgcgcccagccaaaccttactatttttttaaagaattttttccagagtttaatttctgacatagcttaagttttccagtaactctaaactccatctcctttatcgtcattaagtcattcacaaaaagccaggagaagcatttggaaagggcatgataatcagtataataatttgccttgtgtggtcagcacttaactgtttacaaagccctttcacgtgcacagcaggtgggaactgcgcggtgtgggctgggcctgcgctggaagcatatcccgtgaaaagtgttagtgccttaggtgaaagcaacatgtatccctttagactactaacggtatatgttgttcttatgtatttgtatttatttctattttttctatgtttatgtcatatttaaacgatatcctactgcttgttggtattaccctaaactgtttaaataaagagctctatttttaaagaaaaaaggtacaattga

SEQ ID NO: 14779 - DNA, 1476 bp, Homo sapiens
cggcaggaaggccatggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccaggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatg

SEQ ID NO: 14780 - DNA, 674 bp, Homo sapiens
atggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaaggtgggaagctcctttcctgcccccaggctaggcccgctcctccaccccttcttactcaggttcttctcaccctcccagcctgctcctgcacccctcctccaggaagtcttccctgtacactcctgacttctggcagtcagccctaataaaatctgatcaaagta

SEQ ID NO: 14781 - DNA, 953 bp, Homo sapiens
tcctcctaaagggccgcataatattgcgcgtcgtggcgtgtgccttactgggaagctactgctgtccaggtgaacaccacagccttcggggtcagaaagacagctttccccagaacaagcacctgaagctctggggcctgccgctccccgggagagaaggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggtatagcaaatctgggggtgtgcagcaggtggggaggggttgagagtaaggg

SEQ ID NO: 14782 - DNA, 1476 bp, Homo sapiens
atggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtga

SEQ ID NO: 14783 - DNA, 1050 bp, Homo sapiens
gaggttccatgtcagataaagatccttccgacgcctgccccacaccaccacctccccccgccttgcccggggttgtgggcaccttgctgctgcacatataaggcgggaggctgttgccaactcttcagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttgagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaaca

SEQ ID NO: 14784 - DNA, 1706 bp, Homo sapiens
gtcaggttcatggttacgaagctgctgaccccaggatcccagcccgtgggagagaagggggtctctgacagcccccacccctccccactgccagatccttattgggtctgagtttcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaa

SEQ ID NO: 14785 - DNA, 903 bp, Homo sapiens
atggtcctcctttggctcacgctgctcctgatcgccctgccctgtctcctgcaaacgaaggaaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttga

SEQ ID NO: 14786 - DNA, 662 bp, Homo sapiens
cttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatac

SEQ ID NO: 14787 - DNA, 2212 bp, Homo sapiens
ttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaagctctctccccagccttcatgtgttaacctggggatgatgtggacctgggcactgtggatgctcccctcactctgcaaattcagcctggcagcgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcct

SEQ ID NO: 14788 - DNA, 2021 bp, Homo sapiens
cagcagaacatctgtggaacatcccctgatacatgaagctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggactagaattctgtcttcctgcccaacttcaatataa

SEQ ID NO: 14789 - DNA, 2529 bp, Homo sapiens
tgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactca

SEQ ID NO: 14790 - DNA, 2903 bp, Homo sapiens
tgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattagtttcactcttgtcgccaggttggagtacaatggcacgatcttggctcactgcaacctctgcctcccgggttcaagcgattctcctgcctcagcctcccgagtagctgggattacagttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaagctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactca

SEQ ID NO: 14791 - DNA, 2426 bp, Homo sapiens
caccagacagcactccagcactctgcttggggggcattcgaaacagcaaaatcactcataaaaggcaaaaaattgcaaaaaaaaatagtaataaccagcatggcactaaatagaccatgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaaata

SEQ ID NO: 14792 - DNA, 2577 bp, Homo sapiens
tgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaaatgcgaccatagcatgagaccctcggggcctcagtgtggatggcccttgccagagaagatgtcaagactcggcacgcagcgcttgcttggccctgccacatcctgcctaggttaaagtttcccctgccccttgagctgccagttgaacttggtcggcaaagatgcgaccttgtactgggaagaagggatggtgataagcccgagttttgtaaaggaa

SEQ ID NO: 14793 - DNA, 2414 bp, Homo sapiens
cagcagaacatctgtggaacatcccctgatacatgaagctctctccccagccttcatgtgttaacctggggatgatgtggacctgggcactgtggatgctcccctcactctgcaaattcagcctggcagttcctaacaggccatggacccgtaccttgcccagcggttgaggaatcctgctagactacagcctggcaacctcccccggacttgctgtacctggtgaaataggctaccagccagatgaccttggtgcatgggacccatccgcatctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaa

SEQ ID NO: 14794 - DNA, 2672 bp, Homo sapiens
ggagagtcccacctctaacatctcctgtaggcctggcaatggcaggcaggaaagacagaggaaggaaggagggagaagggaaggagtgaaggaaggagtgaaaaaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaa

SEQ ID NO: 14795 - DNA, 2700 bp, Homo sapiens
cgctgggaatcctgctcctcctcaggtcctggcagtttcagggcccctccctaggccttacttaaaaggctgaggcatccttggaggaacaggcagactccacagctcccgccaggagaaaggaacattctgaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaa

SEQ ID NO: 14796 - DNA, 403 bp, Homo sapiens
ttttctgttgtttattccaaaataggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccg

SEQ ID NO: 14797 - DNA, 3446 bp, Homo sapiens
caggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttt

SEQ ID NO: 14798 - DNA, 2900 bp, Homo sapiens
gcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcct

SEQ ID NO: 14799 - DNA, 794 bp, Homo sapiens
aaagccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactttagtgtttgc

SEQ ID NO: 14800 - DNA, 3667 bp, Homo sapiens
cccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 14801 - DNA, 1106 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaa

SEQ ID NO: 14802 - DNA, 2656 bp, Homo sapiens
gcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcct

SEQ ID NO: 14803 - DNA, 2001 bp, Homo sapiens
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaa

SEQ ID NO: 14804 - DNA, 1328 bp, Homo sapiens
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagatt

SEQ ID NO: 14805 - DNA, 2403 bp, Homo sapiens
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgaggtcctctgcattttcatatacatcttagattcagctgacaattttctacaaaaaaagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctc

SEQ ID NO: 14806 - DNA, 1828 bp, Homo sapiens
agtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagattacatgtgttttttaatttttatttattttgccaagcactatgctaaatacataatcttagtcctatcaaaaaacttgtttggaaagtttaggtaattggcttaactctgttctgcatggccaacaagtggcagggatggggctctaaccccagattaactgactctagcacttgatctctggacactctggcatggtgggac

SEQ ID NO: 14807 - DNA, 978 bp, Homo sapiens
atgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttga

SEQ ID NO: 14808 - DNA, 839 bp, Homo sapiens
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataagggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactg

SEQ ID NO: 14809 - DNA, 1664 bp, Homo sapiens
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgtt

SEQ ID NO: 14810 - DNA, 2252 bp, Homo sapiens
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaataaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccac

SEQ ID NO: 14811 - DNA, 788 bp, Homo sapiens
tttgcaaaacgagactgttaataaaacctaccccagggtaggacggactgttcgggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgct

SEQ ID NO: 14812 - DNA, 636 bp, Homo sapiens
atgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccaggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttga

SEQ ID NO: 14813 - DNA, 2514 bp, Homo sapiens
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatat

SEQ ID NO: 14814 - DNA, 1389 bp, Homo sapiens
ctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgcca

SEQ ID NO: 14815 - DNA, 3217 bp, Homo sapiens
ggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaa

SEQ ID NO: 14816 - DNA, 5914 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaata

SEQ ID NO: 14817 - DNA, 8750 bp, Homo sapiens
tattacatgtgtctgttgcagaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacac

SEQ ID NO: 14818 - DNA, 8667 bp, Homo sapiens
tattacatgtgtctgttgcagaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacac

SEQ ID NO: 14819 - DNA, 8567 bp, Homo sapiens
tattacatgtgtctgttgcagaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacac

SEQ ID NO: 14820 - DNA, 9008 bp, Homo sapiens
agccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacacacaaaaataaaagccaaaaaaaaaccaaaa

SEQ ID NO: 14821 - DNA, 1878 bp, Homo sapiens
ggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtg

SEQ ID NO: 14822 - DNA, 2491 bp, Homo sapiens
atgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtga

SEQ ID NO: 14823 - DNA, 987 bp, Homo sapiens
atgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataccatcttctctttc

SEQ ID NO: 14824 - DNA, 4626 bp, Homo sapiens
gtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttggtttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaagatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctcttgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaaca

SEQ ID NO: 14825 - DNA, 1708 bp, Homo sapiens
gtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagagg

SEQ ID NO: 14826 - DNA, 1004 bp, Homo sapiens
cttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaaga

SEQ ID NO: 14827 - DNA, 562 bp, Homo sapiens
aaatgctagagactattcatttaggaccagagtggcattagctttcctacagccatcctcacctgcttgacacccttggatgttgggtttttttgtttgtttgtttgtttgtttgttgttttttttttccacagctcttgtggtccccagcctctctcttgagcagggctggctttttttttttaataagatagctggtgcccaagattgttttccaccttaaggataaaacctgttaagaaaggtcatagtttgccagcccctgccctaaacaaataattcttgaatgcctactgtggtgtgtaagatatgagtaaataccagggatacacagagaacaaaagagaaaaactgctattcttgtgaaacttggaagttggagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttga

SEQ ID NO: 14828 - DNA, 551 bp, Homo sapiens
cttttaaagtgggcccttagtcaggagcggtggctcatgcctgtagtcctagcactttgggaggctgaggcaggcagatcacttgaggtcaggagttcgagacaagcctggccaacatggcgaaaccccgtctccactgaaaacacaaaaattaggctggcatagtggcatttgcctgtagtcctagctactcaggaggctgaggcaggagaattgcttgaacctgggaggtggaaattgcagtgagccgagatcatgctattgtactccagcctgggcaacaaagcaagactctgtctcaaaaaaataaaaattaaaaaaataaagtagcctctagcctaagatagcttgagcctaggtgtgaatctactgccttactctgatgtaagcacaaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagc

SEQ ID NO: 14829 - DNA, 1944 bp, Homo sapiens
agcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgttaagctggacccgccctctgacttgcagagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctgg

SEQ ID NO: 14830 - DNA, 2032 bp, Homo sapiens
cagagatagttgggtgacaaatcacctccaggttggggatgcctcagacttgtgatgggactgggcagatgcatctgggaagtaactgctgcaagaacggacagacactgctgcagagaacttgccacggtgtttcatgctgtggctggtggttccaggctgcacgctccattctaggaaaggggccctcagcccagtcccttgcaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgtt

SEQ ID NO: 14831 - DNA, 2278 bp, Homo sapiens
agcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaagtaactgctgcaagaacggacagacactgctgcagagaacttgccacggtgtttcatgctgtggctggtggttccaggctgcacgctccattctaggaaaggggccctcagcccagtcccttgcaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgttaagctggacccgccctctgacttgcagagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgtt

SEQ ID NO: 14832 - DNA, 1426 bp, Homo sapiens
gctgtgcacccagagatagttgggtgacaaatcacctccaggttggggatgcctcagacttgtgatgggactgggcagatgcatctgggaaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgttaagctggacccgccctctgacttgcagagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcatgagggttggcggccagtatgggaggcttgtcagtgcttggagccttttttgtatattcagtgaatttcaatttatacgcgtatctcaaatggggaaaaattagctttattttccattgctgatttctttttg

SEQ ID NO: 14833 - DNA, 2032 bp, Homo sapiens; identical to SEQ ID NO: 14830

SEQ ID NO: 14834 - DNA, 3483 bp, Homo sapiens
ttccccgccggtccgcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtc

SEQ ID NO: 14835 - DNA, 8663 bp, Homo sapiens
gctttcaaaaataaacttttgtaagaagtaatgacaccgctagccgtccacaccaggagaccgcctagccgtggggcacggtgggctcctgggagctctgagctctgggctttctccagttcgcactctgcttgtctcggcagctccgtccccaccgcagaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggcagagagactttcaagcagctggctggatgttcgtcatattgaaaagtatgtagaccaaggtaaaagtggaacaagagaattactttggtcctgggcacagaaaaacaagaccatcggtgaccttttacaggtcctccaggagatgggacatcgtcgagctattcatttaattacaaactatggagcagtgttgagtccttcagagaagagttatcaggaaggtggatttccaaatatattattcaaggaaacagccaatgtcaccgtggataatgttcttattcctgaacataatgaaaaaggaatactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatcaggataattgtctcatgaccaaatccacgctcaattagagccattcaaaattccttaagatcatgggttctgacttcagccaaacaaaacaatcaaaacctaccaaaaagggactggattgtaatgtcctctccatcatcctcagtgtgagtcctcagagcctccatctgccaagaacattcagttggattccatcgtttggtttagcttgcttgcacgggttgtaggaaatgtctaatttgtaaatgttaatagatacctttggaaagaatcaccttgttattctgattgacccctcttgttttttggttaatccctgactagcctgcttgtctgaaaatgagccaggttcacccttagctacggcatgctctgggttgaaaggggatttcttcccaagatctatcctaaactcttaggacagtttatcctgtattgactattattacagctttttaaaaacagacttagtgacctattatatcttaaggagactatgtgaaatgtccatcaagtaatttttattcctgagaaaatggctggtcaagggcctaggtcagctttttgtttaatctacacctttcaactctgggccttcattcctgctgtttcttggatctccctcttttgaaatcctaccaatcatcagagctctacaaaacagccacctcctggaagcttccctaatctctacaaccagaagtactccctttatcagtatttccacagcaatttctttgtatttctattttatatttatcactttctgaattatatcaaagctgcttgtcttatctctttttttttttgagacggagtctcgctctgtcatccaggctggagtgcagtggcacaatctcggctcaccgcaaggtctgcctcccgggttcacgccattctcctgcctcagcctcccgagtaaaggtgggactacaggcgcccgccactacgcccggctaattttttgtatttttagtagagacggggtttcaccatgttaggcaggatggtctcgatctcctgacctcatgatccgcctgcctggcctcccaaagtgctgggattacaggcgtgagccaccgcgcccagccttcatctcttttactaggttgtaaactccctatattagttttctattgtttttgtaacacattatcacaaatttagtgacttaaagtaacataaattaattattttgcagttctggaggtcagaattccttagcattctttctggaggctgttggggagaactcactgccttgccttttccagcttctagaggccacctgccttctttggctcatggcctcttcctccgtcttcaaagccagcaacgtgacatttcagatctccctctctctgtctgtctcaccgcatctcttcactaccctcttcctctcattctggcccttctgcatgtcttttataaagacctttgtgatttcactgggcccactcatataagccaggaaaatctctgtgtctcagatccttaatttaattacacctgcaaagtccgttttctcgtgtaaagtaacatattcacaggtttctggaattgggacgtggacatcttcgggggaccattactctgtctgtcatactccctgagtgtgtaagggccatctcttcagagcctaatgtgtcatcctacacagagcaggtgtttccttataaattaagttgaattaaattacccctatgaagccacataatcaataattcagctataataaacattgccgaataaattaacaaagggaggataatgactccttatgatgatggatagaaacactgaagaaaaccattttcagaggatttactgaattttcctctccaaggagcttgtaatagaagggtaaacctctagtttcttgtccagcagaggaataggctcatgtcttttgttttattttatttttttggtgagtcagtatggttgggttaatcatattcacattagattccatgttgaagaacaactaatcaaagaagaaaatcatcaggaatcagggtgagattaacagaccaaggtcagaaacatggagttacaattttccaaaaaagcacgaagtgagattaaaaccacagtaagtcttagtctgactgacaggctttatacaggccctcggtaagcagttgggagaacccatgcccaccactgctctgtacggtatctggctgctcagagctctctgattcacaaaagagatcatcaagaattgactctgtgttaaactgtttttcacttagaatatggacccccaccaatacattcaatgaagggtcattaaggaagctctgattaacaccaggcccatgcagttactccgcacatataatctgtgggtattatgttgatttgaacttgcttagctgacttaaagcagggtttctcaaactgtagtatgcatcagaatgacttggaaagctggttaaaaacgcagattgctgggtccacccagcttctgatgcaataggtctggggttagaaattttgctttctaatgagttcccaggtgatgctgatgccaatgatgtgaagcccgctcttcacatccgtgaaaatcgctgccttaaggtgctcttaaattgttatagattggtagatcctacctttccatcactggtatgttttttgagaaaaggatcctttcttttcattctgttatattcatcctattacataggatgttggttagcacagagtgggagctctagaaagattgttgaccaatcatcttattgactagaccatctttctagagtataactattttggacacctcaaagatgaagtcagataagctggcagtgacctgattaacgttgtggtaagcagatgccactgtggctgggaagtaccaaatcttctgttgagtgattcagtcttcctgactagatttgccttctagtgggtgtattaataagcgttagttgatatgaattaaatgttgcaactttctatgggtaataagaggatacctttatagtttcatgatgtggagaccaagatacataagaaagcaagaatgagtctccgggtgttccctctgatcagcaaacatgaattcataatttcatttactctcatttttgtaatgcactctgagcaatcctccaggcagatcctatttactaagcttcaggcttttgtcccattttataatgcccaaacacatggagaaaacattttgttgtttttaaaaacaggtatgggatttctgatataatcaattttattgacttcttgggagttgtaatgatctgtgactcactgcataatattgtagttttatagggtggcacatcaccctgtgtaaaacaactttaatgacctgaggactgatgagtacaggaagtgaggtttatcatgagtagcatttattaagcatctgctagaatcaaagcactgcattagctactaaggtacaaagtaagacacagtttaataaggaagacagggcatctacccaagtcaacagttcagtgacatctgttatttgaaccacacaccaatgcaaccgaagtaaatgctgaaagggtgagaagaaggaatagattactatgcatttttgagaggatgaagaaggcttcttggagaaggtttctgaaaagagatacggaattaagagaaatagaaaagagcactgacgaagcactcaggatggctattcaaggaattggggatccacagcagctgtgcacaaccatccctaatgccagaaaaatggggtaagggtgaagggaactgggtctagagctttgcatgtttttttctggttaacccttagagtcaccctgaaggtgtggatcccatcttataataaggtgaggacactgagtcaggaaactaacttgctaaaatcaagtcctcccagtcctcccatcaggtccttccagatctggaggagccaggatttgaactcacatttgtctgacttcaaaatccatgctttttcttgtgttccaaattgcacaatggagtcactgccagttcaagctcctatgaaaagggatggatgtgaaaagtcatttgttgattccacagatttttagtaggtaccatgtctcctgcctttatcactatcctactcctctgctacaacttctctgctacaggcacccactgcagttacttgatatgagttaaatgaatccatccatccaaacttccattcattgaataaatacttagcaatggcttcctttgtatcaggcactattctaggagctggggctacagtgcagatggaaaccagcaaagctcactgccctcatggagcttatatgtaagtgaataaatctcagggtggttctcctgtcataggtcctggctcctctgccagctcttccaaatgggttcagagaggttttctccttgtcctgttgtgtaactgataatcccatggtggacctcactttgctattcatatgcactaagtagtttatggtgtgctttgtggctggcaattgtgacagattctattcttctattggtatgtggtttctttggggcatttgtttggatactgatggcatcttccgggggtctgaggcacctacacaaacctcaggtcactatcacgtgatactggagttgcctgttaaattatatttcttcttccacaaaactgcaggttccctgagggaaaggtctatgtcctgctcatttttggatccctaatggctggcacagtacctggtgcataatatggttcaacaaatatttgtaaaatgaatgaatcaaatagtccttcaaagcatcttcagaatcaagattgtcatctagattgcacccgaagtttatctttctagtattcagaatataatcaatcattgcttaaattattccatttcatcattcttgaataaaagctactaattttaaatactaatatctgagatatcttcgaaaagaagattagtcgttgtatgtgttgcttataaattttctctatggtggaaaatattcccaaaccatgtctaagcaatgaaaaaccagtgttctggcaggaaataaactgatgtttgttgtgttttgtatctgtcttcccgttccaaatcatttatatatacttgatggtctgtgggcttgacttgcaagtattttcctgggagacatttttattcaaaagacctgtattgcctgccaaaccttcatttaagagactcattatggatgtcatctgcatcattgcaaacttttctggtcgtctctataaatagcaagataatatttacagagttttacattggctcttgaattttaaaatattcttatagacaaacattaattggaatggggggtaaggaggtaggaatggcttacttgcggaaatgcaggctcattgttgtgtctagtaggtgctaggtgcattcacacatctcttaagctttaaacaacctattgagccggtttccatttccttgatctattagatttaaaaaaatgaagcataaaggagttggctcttgccctaagtcatactactgatggaatgagaatacaaaccaaaaacactttattcaagtccaggaaatatctgccttgaaaaagaataacttaaaaattaaaagtgtcctctatttgaacatgaaaacagctaataaagatgtgttattttattttattattattaattttgtcctcccatattggcaaagataaagcaattgacaaaaatggaattcttgttcaatactggcaggagtgaaaattggtagaacctttctagaaggcaatttggcaacatgtatgaaaacctaaatgttgatacacctttacccagcagtttgtttaggaatttatcctaatgaataaaagttgtccaagtcttcaaacatgagcccaaaggtatatttcatgatgtttatgatattaaaacattggaaacaactgaaacatccttcagtaaaagatggattaaataaattccatgcagttgtcatttaaaaatatttagatatatgtttattgctatggatatatgttcccaaaatattattgaatcaaaaagtagactacaggatatatgttgaatatgagctcatttataacattgaatattttaagataatgtatgtttcatagagagatcttcaccaaatgttaaggatttttttttctgggctgtggtatttgggtgatctttacattcttcagactcatgtgtgtttgaaactttttataatgaacatatatcatttttattagaaaagaataaagtttttgaaaaaaaaaa

SEQ ID NO: 14836 - DNA, 1853 bp, Homo sapiens
gacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggagcagtgttgagtccttcagagaagagttatcaggaaggtggatttccaaatatattattcaaggaaacagccaatgtcaccgtggataatgttcttattcctgaacataatgaaaaaggaatactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatca

SEQ ID NO: 14837 - DNA, 1381 bp, Homo sapiens
atgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaa

SEQ ID NO: 14838 - DNA, 4147 bp, Homo sapiens
cccgccccttcgcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgtt

SEQ ID NO: 14839 - DNA, 1409 bp, Homo sapiens
cccgccccttcgcggcgcttcctagttcggctggttcttctgtcgccggcttcagcagcccgcgcccgggcagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtt

SEQ ID NO: 14840 - DNA, 2835 bp, Homo sapiens
gcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaa

SEQ ID NO: 14841 - DNA, 547 bp, Homo sapiens
ccttcgcggcgcttcctagttcggctggttcttctgtcgccggcttcagcagcccgcgcccgggcaggggcctggagcagtatctagcacaaagtagacactcagtaaatatttgctggattttcttcatatacatcaaccaaaacaacatgctgcagtgggttgagtgcagaagcagatacaagaattcagctctcttctattaagttaaatattgaagagattagcaaaactttaaaacaatgttgttcttctgtttttgaggaaaaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatcc

SEQ ID NO: 14842 - DNA, 1684 bp, Homo sapiens
cttcctagttcggctggttcttctgtcgccggcttcagcagcccgcgcccgggcaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccct

SEQ ID NO: 14843 - DNA, 3558 bp, Homo sapiens
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtcagtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaattcctgtcttccaccacagatgaacaatgtcttcctataataacttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatactc

SEQ ID NO: 14844 - DNA, 835 bp, Homo sapiens
gagagacccaacgggacctcagcccagccagcccaggtgaagcctgaattttataggcaagctgagctgaaaccttgcccttggacaggatccaatcaaaggagatgtatcactttctgtccaacacctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactg

SEQ ID NO: 14845 - DNA, 5795 bp, Homo sapiens
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagaaaagaataaaggtaaaaccaaaccattcaatatcttacagtttggaaacaaccatcatgaacatttactgcctattttctgccttctttcttctattatatacacatattactgagaccatatttacttagagtttgtatcattttttccacttaacctgatgtaaaggatattttatagttcactaaaatttcttcaaagttatcattttaatgacttgcaacattctgttgcatccatatggatgtcatcaacttaaccattgcatcattgtatctgacattacaaatagtgttttaattaagatatttaaacataaatctttgtcaaatcactaatttctcaaaatagattactaagtcaaacactatggattttaaggcttttaataaattttgccaaattttttttccagaaattttgttacaatttaaatatcccactggcagaaaagacaagaacctgtctcattgcagcacttatcaatattgaatattactatttattctagagtttgccaaaaggcagaggaaaatcatttctcctgtgtttattagatgtttgaaatttctctttcatgtatatttctattgcagtcttcccattttcacataaaagaatacttttaaatatacacaataaaactattctctgggcaatgtgttccccagttcatttgatttttggtaatgtgaataatgttttaagaaattaatttttcatgacttaaaatgtagaaattgagaaaatagatatttgtaaataaatgatattactttcccatttcttcctttactgacattcagagaaagccggctgtgcctatatttcaattttctcctaagttcagctaatttatcatttctggactgacttgtagctaataataggacaagcctagttgaattttaattataaaatgacagtaaaatgcatttttaacaataaaaagaagagctacatagttaattcccccatataaacagctcaaatttgacctgtgacacctaatatcaagtcttattcaaaaaggtattatttagaggaggagcatataaacatgtaaaaagacgttttgtactgacttcattttaatatgggaaaacaaaattaataagagaattgaaatttgtatttctactttaaacttgaaggtaatgtactttagctgatagaaacttttgtaataacaagattagatttagtaagttagagtaagttaatatgacccctttcttataaattatttttcatttttttaaataaaaactttgagggatcagtggacaattcatatattataatataatatgatatatcatcaccatatatttaagttctagcaacaaatgttttagaattatttccccagtacttctggacacctccagttgaagtatacacacagaacagttaagattagattttgattgggaaatgttactaggtgcctaggtgtgaaggaagagtgagaaatctccaaaagaggctgaatgtgctcgaagacaaacccaggctacctaataattgtttttaggtgtaagtatgtgaataatttatcttttcaaggcaataaaatggaaggatagccaaataaaaatttgttcttctagggtaccagctaagtacttttttattgtaacaaaaattgtagcataaaccgattattcatagaattacaaagtttgaaggtgccttacattggtaatagtctgatgaagtccagagcacagaacacctccatcccaattgctcacagcaggattcttcaatgagggcagaaggggaagatgccagggaccacatcctttgaggttctgatatgccacagggtatgtactttattagccaaaaaactgccttgcctagatgattctgatacccactctcacgcccccactaggaagcacaattccacacccagggcaattacttcacagagcctcacagtgacaagtaaccacttgtgaccgcagattcccaggtaccacatactcttcagggagtaaggaaagattgaatcatttttcagtatatcttgttttctaaaacacaagaataaactaaggcattctatgtttttgcctaattaaggttgaaatggaaagttgtttctggctaaatataaaccaattaactataacactattttctctgagcatttttttaaataataatttattacaaaatagaaatgcatttgtattataataacgcttttttctttgcttgaatagaacccagacttgcactctatgaagatctttaaaaatatcaaaacatttgccacatatttgaaatggtttatggtgatctgttctaaaagaagtgaaattcatagcatcttaaatgttctttcatctcttggattttctgattaaaatcttattcctcaatgattgcttaagcaatctacattttaaagacttgggcagtattctaagaaaaccctcagaagagcaaattcaagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtcagtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaattcctgtcttccaccacagatgaacaatgtcttcctataataacttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatactc

SEQ ID NO: 14846 - DNA, 4157 bp, Homo sapiens
gctactttgaaaggacaaccatttttctttccgctaatttataatggttttgaagtggttgttcattctcaaacatagacttttaaatgttaggtctttcctataactctttgttattggaagtttcaaggatttggacactcaattaaggattctgtcctctcctcattcctttggttttggcccaaatgattatgtttcctctttttgggaagatttctctgggtattttgatatttgtcctgatagaaggagactttccatcattaacagcacaaacctacttatctatagaggagatccaagaacccaagagtgcagtttcttttctcctgcctgaagaatcaacagacctttctctagctaccaaaaagaaacagcctctggaccgcagagaaactgaaagacagtggttaatcagaaggcggagatctattctgtttcctaatggagtgaaaatctgcccagatgaaagtgttgcagaggctgtggcaaatcatgtgaagtattttaaagtccgagtgtgtcaggaagctgtctgggaagccttcaggactttttgggatcgacttcctgggcgtgaggaatatcattactggatgaatttgtgtgaggatggagtcacaagtatatttgaaatgggcacaaattttagtgaatctgtggaacatagaagcttaatcatgaagaaactgacttatgcaaaggaaactgtaagcagctctgaactgtcttctccagttcctgttggtgatacttcaacattgggagacactactctcagtgttccacatccagaggtggacgcctatgaaggtgcctcagagagcagcttggaaaggccagaggagagtattagcaatgaaattgagaatgtgatagaagaagccacaaaaccagcaggtgaacagattgcagaattcagtatccaccttttggggaagcagtacagggaagaactacaggattcctccagctttcaccaccagcaccttgaagaagaatttatttcagaggttgaaaatgcatttactgggttaccaggctacaaggaaattcgtgtacttgaatttaggtcccccaaggaaaatgacagtggcgtagatgtttactatgcagttaccttcaatggtgaggccatcagcaataccacctgggacctcattagccttcactccaacaaggtggaaaaccatggccttgtggaactggatgataaacccactgttgtttatacaatcagtaacttcagagattatattgctgagacattgcagcagaattttttgctggggaactcttccttgaatccagatcctgattccctgcagcttatcaatgtgagaggagttttgcgtcaccaaactgaagatctagtttggaacacccaaagttcaagtcttcaggcaacgccgtcatctattctggataatacctttcaagctgcatggccctcagcagatgaatccatcaccagcagtattccaccacttgatttcagctctggtcctccctcagccactggcagggaactctggtcagaaagtcctttgggtgatttagtgtctacacacaaattagcctttccctcgaagatgggcctcagctcttccccagaggttttagaggttagcagcttgactcttcattctgtcaccccggcagtgcttcagactggcttgcctgtggcttctgaggaaaggacttctggatctcacttggtagaagatggattagccaatgttgaagagtcagaagattttctttctattgattcattgccttcaagttcattcactcaacctgtgccaaaagaaacaataccatccatggaagactctgatgtgtccttaacatcttcaccatatctgacctcttctataccttttggcttggactccttgacctccaaagtcaaagaccaattaaaagtgagccctttcctgccagatgcatccatggaaaaagagttaatatttgacggtggtttaggttcagggtctgggcaaaaggtagatctgattacttggccatggagtgagacttcatcagagaagagcgctgaaccactgtccaagccgtggcttgaagatgatgattcacttttgccagctgagattgaagacaagaaactagttttagttgacaaaatggattccacagaccaaattagtaagcactcaaaatatgaacatgatgacagatccacacactttccagaggaagagcctcttagtgggcctgctgtgcccatcttcgcagatactgcagctgaatctgcgtctctaaccctccccaagcacatatcagaagtacctggtgttgatgattactcagttaccaaagcacctcttatactgacatctgtagcaatctctgcctctactgataaatcagatcaggcagatgccatcctaagggaggatatggaacaaattactgagtcatccaactatgaatggtttgacagtgaggtttcaatggtaaagccagatatgcaaactttgtggactatattgccagaatcagagagagtttggacaagaacttcttccctagagaaattgtccagagacatattggcaagtacaccacagagtgctgacaggctctggttatctgtgacacagtctaccaaattgcctccaaccacaatctccaccctgctagaggatgaagtaattatgggtgtacaggatatttcgttagaactggaccggataggcacagattactatcagcctgagcaagtccaagagcaaaatggcaaggttggtagttatgtggaaatgtcaacaagtgttcactccacagagatggttagtgtggcttggcccacagaaggaggagatgacttgagttatacccagacttcaggagctttggtggttttcttcagcctccgagtgactaacatgatgttttcagaagatctgtttaataaaaactccttggagtataaagccctggagcaaagattcttagaattgctggttccctatctccagtcaaatctcacggggttccagaacttagaaatcctcaacttcagaaatggcagcattgtggtgaacagtcgaatgaagtttgccaattctgtccctcctaacgtcaacaatgcggtgtacatgattctggaagacttttgtaccactgcctacaataccatgaacttggctattgataaatactctcttgatgtggaatcaggtgatgaagccaacccttgcaagtttcaggcctgtaatgaattttcagagtgtctggtcaacccctggagtggagaagcaaagtgcagatgcttccctggatacctgagtgtggaagaacggccctgtcagagtctctgtgacctacagcctgacttctgcttgaatgatggaaagtgtgacattatgcctgggcacggggccatttgtaggtgccgggtgggtgagaactggtggtaccgaggcaagcactgtgaggaatttgtgtctgagcccgtgatcataggcatcactattgcctccgtggttggacttcttgtcatcttttctgctatcatctacttcttcatcaggactctccaagcacaccatgacaggagtgaaagagagagtcccttcagtggctccagcaggcagcctgacagcctctcatctattgagaatgctgtgaagtacaaccccgtgtatgaaagtcacagggctggatgtgagaagtatgagggaccctatcctcagcatcccttctacagctctgctagcggagacgtgattggtgggctgagcagagaagaaatcagacagatgtatgagagcagtgagctttccagagaggaaattcaagagagaatgagagttttggaactgtatgccaatgatcctgagtttgcagcttttgtgagagagcaacaagtggaagaggtttaaccaaaactcctgttctgaaactgattagaagcctggagaagatggagattacttgttacttatgtcatataattaacctggattttaaacactgttggaagaagagttttctatgaaaaaattaaatatagggcacactgtttttttttcagcttaagttttcagaatgtagtaagagatgttaccatttttatttctataaagactgaatgctgtgtttaaataaattgaaaactacgtaaa

SEQ ID NO: 14847 - DNA, 200 bp, Homo sapiens
tggatacctgagtgtggaagaacggccctgtcagagtctctgtgacctacagcctgacttctgcttgaatgatggaaagtgtgacattatgcctgggcacggggccatttgtagtggctccagcaggcagcctgacagcctctcatctattgagaatgctgtgaagtacaaccccgtgtatgaaagtcacagggctggat

SEQ ID NO: 14848 - DNA, 3280 bp, Homo sapiens
catggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacc

SEQ ID NO: 14849 - DNA, 949 bp, Homo sapiens
acccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggac

SEQ ID NO: 14850 - DNA, 6439 bp, Homo sapiens
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtaattgggtgctgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgt

SEQ ID NO: 14851 - DNA, 6226 bp, Homo sapiens
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtaattgggtgctgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgt

SEQ ID NO: 14852 - DNA, 3505 bp, Homo sapiens
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctggtccctcctgtaacgtgaaataa

SEQ ID NO: 14853 - DNA, 5437 bp, Homo sapiens
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaa

SEQ ID NO: 14854 - DNA, 17015 bp, Homo sapiens
ggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgtgaaaaggaaaaatatcaagctggaggttgggaaagaaaatgaaggcagtccattatgtggtgggtgaaagaccctaggaggatgcaagccccgcacatcccggggcaaagacctaagacacttttccaccctccaccaccccaacctcacataatatgcttgttgcaagagtcaggactttatgactatgtgccaagctgtttggtttgagttctttaatttttttttcccttaaatgccaggagatcatctggttagttagatagtaacttgatttgctaatgaaaagtgggggccgtgttttgtttgcatgttaatattctcataatcctagtttgttgtggtcatgaaatgtcctttgcatgttctgttggtactggagtctagctttcctgtactagatggtgttctctttgattgtaggtccttagactttaattagggttatcaaagtgctttctaaatgatagcatcagcgttgtggcagagtacctcctttgctgggaactgaatgtgtagtgttatcatttcccatgagagcccggtcatacttcaagcaatttttttaaaagtgtgtgttggaaaggacaacaaagtttacatttcatacttttaagaaatactttattatttatttattgaagatagtgtagaattttgtatcaagaacaacagacataagtattttttgaaacaagcaaatataccctgtagttagaaactttcaactgaacatgttagagaccaagtttaacttcaggcatgcatttgtttaccatttcccagcagaaaacatggttaaaatactttaagtttatattttttgatgttgttaagaaacttttaaattaaatctataaatagacatgcaactcatgctttcctatttctataaccaacaccgtttgtttagtgtatttatgaaagatatgctaccatggtagaaagaaaagtattcaatgtgtaaatggggtagtgtgggtcaccattccgatctctttttgttttctgtcctgtcttttcttcattgactttatttgcgtgttaatgttggacatcattgttcatgtaggtagcgtatggtatgcacaatgacaaacaatcgttttaggtcccaggtcacccactcatagtgtcctattattggaattaatgtagcatgagaaagcaatatgtgactctttttcctcaagtgactctgttgagcatccttgagatgctcctgccatgtagcaagttctggattagtgtccttgtatttactggtgtaatttgtaatgtaaccaattgtccgtatggaggagtcgggctggccctcggacccagctgtgattcatgagttgtgtcacagggattgagaaacatgggtgatgcatggagtctcaaaccattgggcctctctgttccttcacctctaccttcttgaccacctgggctatatttcatagaaattaaatgctccttgccaacaaggagtctgtctcctagctctttgttttctaaatataggagttctctaggccactgcatcccggcatcctgatcccagccttttagacacccctgcaagcgttcctctgctctgagccacactgctagcttctcctgcacactctgatctcctttagcccaagaaggggctgtgctggtcatagggttatgctgtaaccctcagtcttccctgagaactgaactatcctgggacctcttgggctgagccttcttcacagagcagttctctagaaggcagagtccacatcctggtccctctggggcagggcctgtctggctgctggcatcaccctggcaggtggatggacagcatcatctcctggaaccaggtttgctgtgaccatgagagcctgaagatgtggctcattcggatccaggcctggactaatctggaaagagggactttctaggtgcaggtcaccagggatgcttgagaaactagagccagacttccttgtttgtttggataatatgtccctgtcctctgatagcagaggaaagagctctgctcccaaagaacattcatgtaagaggaggcatttttttcttctttgctttttttaaacaacctaaagtatgacctaagtgtatgaaactaactgatttctttgggtagagtagccctgaatttaactggggaaaaaatcccatcagactatgagtaaattgaccacccacattaagtcttatctcggtgacctggtaccaaagcccaggtgtcctccaggggagtattctggggtggcagggggattaggtgctagcgccagcagggaaggacacttgcaggtctgccttccaaggctaagcaggccggctgtctctccaggaactggctaggacaagtgtaaagccactgaccacacagaaccaggatgttctagaatctgatggggctgaagatgaagggagaaatggacaaggcacttctggctttattgaaaaggtgaagctcttggagtatattttagagtaggccagtaccttgtataagcagaaaaagacttctctatctccactccaagtcgtttttttctagttgattgggcctttttgattgataagaagaaaatgtgttttgtacgtgtaacaactttaagaatttccattggaaacaaagtatgatttgatttgatttgatttctaagttctcccttccttttcaaggttagcgatgtgctttatagcagacactagcacttttacatgaatacctggtgtgctttggatgtaacagggtcattttgggctcgaggtgagtgtgcaattagcagcaggtctgcttggtccagatatgcttgtttacaagtttagagcatcctatgccagaaagtgagatgaaaacaaaggcacctggattgctttgttttgcttttagataaaagagctttagctcacaccaggcagaagcataaccagtagccccagaaaccggtagcatgatgaagccctcagacagtatagtctgagccaccataagaggcattagggaaaactaacacctccttctttttgcaccgtggggtgctgaaattcctgctagagacttccccttacttccatgaatggcccaggggctgcttagtatatcattagaatgttcattctcctccttttccctggagtggaccagtgagaccaaatgcttgtgtttctctatgttttcagttcatttgttcaaatgacccagaagatgaatccatttctgggaaggctgagctcagatgaggattgctaggccagcctaggttctggggcggatctcagggacagaaacaggcttgtattaagtatgagtggcaggtacttctctagaacagccctaacctgcactagtgaggggggctcaggaattcccatgacattgatctagcagcctcctgcacgtagacactcagttcattttagggacgttcaatgcttgatcaaatggggggcattttctttctttctttttttccccagctacagtgtaattgcctacctgcctgggccccttctagaggaaggtgggctttccttgtccgtcaggctgcactcatgaggtgatatcgtaaagcagcagaaagactgagggtgcaaagaaaccacagctgccattcacggggcagctccctctagctcttctgcccagtgaccttacaggctttagaggagcctgatgagagctatcctgggggccaagggatgcattccctgcagcttcctcctgggggacccacaggtcagcccattccaggagaagcagtcttaggcccgtttgcatcccctgccactgccatgtgcctgccagcccggtttctgatgaagacgtggctcagtccctgctctccttgtcgcagtggcttgtacttcatgtgcagtagcccagggcccgccttctagagtgaatgtttccctcgagcccttggatatttttattctattttgaatggttccgatcaattaatgttgctttgtgtggggttcttcagagaaataatgcaaaccggccaggtgcggtggctcacacctgtaatcccaacactttgaggggctgaggcaggtggatcacctgaggtcaggagttcgagaacagcctggccaacgtggcgaaaccttgtctctactaaaaatacaaaaattagccaggggtggtggcaggcacctgtaatcccagctactcaggaggctgaggcaggagaatcactcgaacctgggaggcggaggttgcagtgagccgagatcacgccactgcactccagcctgggtaacagagcgagagtccttctcaaaacaaacaaaaaaagagctaatgcagacctcttctggttagacctgacacggaggaagtaattggctggtcaacttaatggcgccccacagcttcctctggatcctgcttctttgtacttggaacacagtttatttgagctagaggaaaggaaagttctagaattcctgtttcctcagcctgcactgtatcagatccaggatatgtctgcatttcatcaggatcaagtaagatacataaccttatatctgtaggagccagaaaaaaaaaaatctattcctgataggcatggaaacttagtccacatgaaagacagaagacatctaacagctgtctgtcttgggagcattaaaacccagacaccaagacacactagacagtccatctctgggttgtgatctctcagaaacatcttagtagttaatgcactgttcatttagggagtccccatcctggtccaggccaccctcctagaagctgggcggcagctggacgggcctgccttggtggcattcaagcaagcctaattggattaggttggtgcaaaagtgattgcggtttttgccattgcttttgatggcaaactaactttaagtcattaaaataagacccaacgcttataaaagagttcatatccacctcccaataacttctttagttccatgcagcctcaatcagttcctccattcaaaggaaccctctttaccctggccctgggggagccatattacacccacatcataatttttctgacactatgtgtgcttgtcaaatttcagggtcagtttccccttattggatgtcaggggtgttttgtgagttgtgttttaataggattctgttcgattttctataccagcctatattgttactatcatctgcctagtatgaatattttagtattcaaagcccaccagataaagctgtgttcagaagtggactttttggtcagccttgaaaaaaaaaaaatcagcatttctctgatatttcctgaggattaaccagaaactaaggtttctttttaggcagtggtaagaatgcgtattttcttcttccagaagttctggttttatacttttatcttttgaaagaataacattcctgtgcgactctgcttctcttcgcttttgcatttctcttttttaactcaaatctcttatttcctgccgttcctgtatctaaacagaatgggggcctcaggcagacaggaaccaaagaaagggtgtagtggctttgcagcgttgggtgagcagcagccgctgccattctgtgcactgtcaccggcgggggtggagggtctccctgtaggaggaggaaactcgctgttttcactggcagatttcaaggtgccggctccacctaccgcagctgctaggcattgctcttgtgtagatcgcagaaggagttattggtgatgtggggtgtaggggaagacaggaaaacggactcagagctaggaatgtgggcctggcagagaccgaaggctgggtgggaaggaagctcgcggcgagcctagggttcaagcctagcgcgccaggggtctccagtgagaccttgctcttccctgccgctgaggctggggctgcacggaggtcctcaggcttcccaccctttctgcatcagctttagtgtctgtcggctgggtggactgcagggcaggtgacctggaggaggccctgctccccagcaagcgttctaggagttacggtgtgctctattgggattggattacagtctctacttgtagactttgacttctggaattttaggtggaagggaatttttgttggtgggacgcagcagctcagtgcgtggtgtgtgcatgcgtgtttgtgcgtgcgtgtgcatgtatgtgtttgtgcgtgcacgtgtgcgtgtgtgtgcatgggtttgcgtgcatgcatgtgtgtgcgtgcgcgtgtttgtgtgtgcatgtgtgtgtgtctacgtgtgtgtgcacgcatgtgtgtgcgtgtatgtgtgcgtgtgtgcatgtttgtgagtgcatgtgtttgtgcgtgtgtgcgtatttgtgtgtgtgcgtgtgtgtgcgtgtgtatgtgcgtgtatgcatgtgcatgtttgtgtgtgcgtgcatatgtgtatgtgtgtgcgcgtgcgtgtgcgtgcatgtgtgcgcatgcgtgtgtacctacccacacctagggggatgcatggctctgtgccttggagagggaaacaggaaatacgttgctccacagtcctgtcatcctggtcaggactagtcgcgtggtttgcggacagagtgcaaaatgaaaatgcgaggccccttgttcaggtgatgaagcatttctagacagtgagaggagagcattaagccaagctcaggtcccttctgagtgcatagccccttgtggctgccaggcagcacacccaggaggccggccctgaccacactgttctctgctggttcccgaagctgatgggctctgtcttaggtcttcttactttgaaaggtctcccggcaggctgtggcaagctgcgcggatacacttttctaaacgtctgcatttatttcctaaaagcacaaatggcctggactagctagtgggtgtggaaccgagcccctagttcacagctgtaccccaaggctggagagggggttgccggtggtggcaggagctctgggctcccagttcaggatgggccacagggcgtcaagcagctgtgagcctttaccattgagctcactgcttggaaataaaacccttcctctgggccttgggcatccactgggagcttttctcccctttcctgggaggacagcaagccttttccaaccttctgccttcaaagagaagcagggtcatagaagtgctcagtgtcccttccccagtggctggacacttgctcctccagccttcaccccctggagagaaggggagtctgcggagccagtgcctccctgcccagctgggccacacgatctggtctgcgggtgtctgggaggaacctgcttcggagaggctgcgacctcccagctagactctccccttaggatcccatgtatggggatggtaggagagaaaagatccctctgtgtaagtagcctcaagttctagaagaccatggccccgggaggcagctgaccatgaagctgggcttcctgttgttgctttctttcacgagcttttacttttcctgggctggacgctccaaaatgtttgcagttccatttgctttttgcaagtaggtccccatctccatatacattgagcaataatcctcactatgtttcctgattctgtctgggattatatttgctaagtaaaaatgttgacagaaattgcaaactcatctcacctggatttgattgagtcaccttgaatgacataacaaattatggctttgttttcatgcgtcatgcaatcttccggactacgggaagttctgcaagtgttctccaggggcatttcattaatagcgtgtcagcattagttttaatgaatgaacatttgaggtacattctataaatcaatatccttaaaatgtcatctgctaaacattcactgtgacagaaagtagatattttagcaagatctatgttaatgctacttaattttagacatgcatttaaagcctacatggccaatagcccaagtatctttgaactgtgaaatcaacctcagatctcatctgctgtagccccgcaagccggagtctgtgccctccatgacccttcttatcccttggtggccctgcatagataggggagttggcccctgcccaccccgtgttgtattgccttagctccatcagctttgtaccctcacacgtataggtggtgaacttatgtgtaaatacatgtgtacagatgagaaactgcaacaaaaatgtcctgtggatgataatcagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatagaaaaaaatttaaaacctattccaagagtagaaaatgcttaatgagattacttgggttcaactcaactaaatttcttatattaaaaaaaaattccaagttgtatatgttagaaatcaaatgagtcattttttttcctgcaggaaatatgataaatttcagtgtaatggatggtggcgtgatcaaatgaaaagtatcctgtagctatgacctcgcatgggaccttggtgttgcattaaaaatggatttttgcagatcacatatctgagagggtacttgtgtcaggaaggatgagaggatagggagcctgtttttcatcagatccatgtgccacgcaggcttccttgggttctagtggatttgttagggatctggggctgacgcagctatcccactagagaggccactctctgacttccaggtcgccctttctacttctgtatctggattgattcagtttatccctaattagcgtttgcgttttccatgaaatttcctgatgcatcctcactgtcttcaactgttgcatagccaggtgggtggatggatggtttagggtttctgagttaagccgttttggggcaggcttctggatgcccatgtttccatggagaccccagggggaagatgccttcctcccgtctgcattcccagaaaaggatcagaagtccaggctgcttctggggcacagactttctgtacttggccaccagaagtgccccttaggccacctaaggaggattctgtgaaactcaatgtctaaacccctgagaaaggcattcagaaatgatttcaggagggggcaaccccaggagtccagcctcccctggcagcctggaaatactgcagtaacaaaaagagctggtttctggtgatctgaatgcattgtgtttgggggtgacaccgctggtggaaggttgagggcctgtggtctgaaaagacatctgaagaatgtgttaggttttcaacatttctttgaacaggctgcgtgcatcttaatgctgtcaaccagcaactggagccccttttttgagaggcccgaaccagtaaagctgctgacttcaggagtatgggaagctgtgatttctggaagcttcctggaatctatttaggtgcatgaataatctgcaaatcacttagaggcactgtccatgtggtccataactggctttattcccaaagatggagctgttcagagatttctttgttcaggcgcagccttggaaggccacctaaggcctgccagcagaggagatgagctctggtctaccaaccccaaacaggccctgactctccttccttagaacgatgccctctggctggggtggcaagagggctgtgagtggaaacaagtcagccagtcaactgtcccttgggccttggttgtttcaaaaaagtctggggacaagaaaagctagaacatggggccctcccttcccaggagtgctagcgaaccctcccagatagcctttgcctgtttggaaaagaatgtaatccatcagaacgtgagctccttgtgcttccagtgacaagcgggccacagtgctggtggcatgttgcttccctcacagccctgcccaggggtaggaccaggcccgccccttgatggatgtgctgttgattgtaatatacttctgttgccaaataatggtactgtttaattttccataaaagagagactatattgtctgatatgtaatgttaatggaattctaagaattactagacactattataaattgtagacttacgtatttgtctaaaggtttgatgaagcagggccaaaacattgtttcttcttttttgtttgaaagaagctgaggtttgtttttgctgtttgagtgttcctttggcaacttattatgtgtgaaatgttaaattttaccgattaagatgatggtaactgagacctttctttaaaccagtagcaacatcagtacaaattgctcttcctgtgtatcttgaacctaaaaagaacaatctcttcaaaaacaaaaacaaaaacaaaaaacaactctttggtcattttgacctgtgtggtttaaattcaaatagttcatgaataaaaggagaaaagccaa

SEQ ID NO: 14855 - DNA, 4993 bp, Homo sapiens
catggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcggg

SEQ ID NO: 14856 - DNA, 3115 bp, Homo sapiens
aggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatag

SEQ ID NO: 14857 - DNA, 5191 bp, Homo sapiens
gaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagt

SEQ ID NO: 14858 - DNA, 5408 bp, Homo sapiens
aggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 14859 - DNA, 3913 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttgcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggct

SEQ ID NO: 14860 - DNA, 4003 bp, Homo sapiens
gaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctt

SEQ ID NO: 14861 - DNA, 5722 bp, Homo sapiens
agggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttccc

SEQ ID NO: 14862 - DNA, 4992 bp, Homo sapiens
catggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcggg

SEQ ID NO: 14863 - DNA, 827 bp, Homo sapiens
agatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtttaagctgtcaccttcccaaatgcggcatctgtgtagccccagagggagcattctaaaaggcagcacttagatgagttgatcccttcacaccccacccagcagttcgttctacctggcaaaacttaacagcttcggtgaagaaacctccacattactgaacatttggaggtgtcccaatgaaaaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttg

SEQ ID NO: 14864 - DNA, 501 bp, Homo sapiens
gttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtttaagctgtcaccttcccaaatgcggcatctgtgtagccccagagggagcattctaaaaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagtttt

SEQ ID NO: 14865 - DNA, 6300 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 14866 - DNA, 5811 bp, Homo sapiens
cagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 14867 - DNA, 6031 bp, Homo sapiens
cggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgg

SEQ ID NO: 14868 - DNA, 6187 bp, Homo sapiens
cggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtaggagctggagctcaggtagtagtgctcactcacctgccactcaccgagccccgctgtccagcccggttcctaacagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgg

SEQ ID NO: 14869 - DNA, 4558 bp, Homo sapiens
ggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatgagagatggtgggcatcagactcagggctgcctccacgcagagtcaaagcaaggcatcacttttgatgtgtgaattcacaaatagtgacggaagctctcacatcctccaaatgctgtctctgcctgccggataatgcttgagattgaaagtctctaatgagctctttcccccagatgaggtcactcagagtgaagcgggagaacaagagggcattcgcatggcttcgttggatgtggcaggagccccatcaaggaaggacggggatagagtggatgggaagggcctatggcagaccgtagcttccttggatatttgcctaatatctgttttaacatctgacattttcataaactggtatctctggaggaactgtgaaacagtgaaagtgttcacctcatggttgtatcagtttggaaaacccaatgggagcatattgtaaaatagttcccaaatatcatatagctactgtttgtttataccagtgacctctacgctgatgacagctatccttattcgagtagcactttaaaatgatttgtgcttgagtgaacaaaagaagactttccatttc

SEQ ID NO: 14870 - DNA, 6116 bp, Homo sapiens
gcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccagcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaattgatttgagtgttctgtttttgt

SEQ ID NO: 14871 - DNA, 6227 bp, Homo sapiens
ggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagttt

SEQ ID NO: 14872 - DNA, 3384 bp, Homo sapiens
agatcaacaactgtcagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaaggtacgttctggagtctggaagcagcagaactgaaggaagtaaacacgggtgtctgggaagacccctcaagctgcagtaaagcccaggactgaattggccacctgaggccaagggtggcactccaacctcctcctaaaggctggctagagccacaggaaagggccagaagccagagaaagggcaaaggtggacccctgcctccaaacctcctctggagactgacctcctctttcctgtgccttattgtttctccctcttctctttgttcgccactgggcggtgacctcagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgagcctgtccttctccattgaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggccctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatttcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctataa

SEQ ID NO: 14873 - DNA, 5745 bp, Homo sapiens
agatcaacaactgtcagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgagcctgtccttctccattgaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggccctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatttcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctataactggatttactttctatgttgtttgcaggaaatgtattctggtaacttctaggttactgatgcctcaggcacttcaggtttaaaggcagtcacttgagatcgttgccctctgttccccttcttcccacaggggtctttgctaggctgaggggcagggttggagaagtgtttatgcaaatgccacctccagcctcccagaggggatgtttgcttcccagctttctcagtctcctactagtgtcttatctagcctggccttgggcatgacccctctgccctagagatgtatcaccccattcaactccctattgggggttcactccacatcctccgctgtagcctctcaccacagttgtgaatcctcgctggcttcctctctttctcatgagcaagaggaaaagctgacaactatcccacacacttctagggccatgggagccctgggccaggcagcaggtctcattcattctagacctcctacagccatttctcatgccctggtgataggaaggtcatggatgagacttgcagatctccaaacttgtaagaggaatggaaaagatgcaggtcccctctgctctggggtcccactcccctttctcagcaacatactccttccccaggctcctcttgaaacaggattttctcaaccatagagattcagatgatcagatgtctcagcttcactactgaggtaaacattgattttgtgaggccacttctttccccccaggaattttctccccaataactatttttattccctttaccttatgtgtgtgggataaaggaatcactttagaactcttgccaggtgtgtgaccttgggcaagtggcatgtcccctctctgtacctgttccctggataacaacaatttcttgcctcttagagtttctgtgacaattaaatgagttaatacattttggcacatggtggacactcaagccatattaagaaaaactcattttcccaaatacaccttctacctctttctacttctgagcttgagcatccattctgatctcaagctctattccaggagttcttaaaccagtctccaggaagtcaaggagctcccaagagactatgcaaaattgtgtgtatctgtgtgtttattttttctagggaaagggttcattgctttcatcagcttttcaaagagctctggggcataaaaaataataataataaagaatctctgtcagacatatctgagtcagatcttgacagcttcatattctagctgtgaggactacagacttgagagaagatgaaggataactattttagaaaggtaaaataaaaaaatattgctatggtttgaatgtgtcccccaaaaaatgtgtgtcagaaacctaatcaccgttgtaacagtgttaagaggtagaacttttaagaggtgattaggccatgagtctctgtccttatgaatggattaatgttgttattaccagaatgtgttccttataaaaggataagttcagaatctctctctctccaccccccaacccccggcaccttctctccccttctctcctccactcctccaccattttccttccaccatggtatgacacaccttgacagcaagaaggccctcaccagatgccagtcccttgttcttggacttcccagcctccagaaccatgagccaataaatttcttttcatatattaattacccaagctgtggtatgctgtaatagcagcacaaaatgaactaaggaaaatagaaaatgaacaaatgcccaagttttatttagctcattaattaatgagagaactgctaagatgtcataaccagctcaaaggtgaacatgcacacatattaaaggaacagacaagcatacaggcaatcaggaatgctgaaatgaattacaaataaagaaaaacaagagtcaatagccatagggaaacaatcaatttcatctccaccaagcatgacttatttgcatttctagtgacaagaatcactttcatttctaaccattctctactcattgaagttgaaaaatagctcaaagataataaagatgcagatattctgaaagaatgtgctagacaaaataccctgtaatctttatgggcccttttcaaaatctttcaaaaatttgtacccgcataaagttactttgtctatctgaatctcactttcctcatccattaaatggggatgaccacctgcctcagaagattgccatgaagattatattagatgatgtgcgtatagtttgtgcgaataaaacactttgagtgtaggaaatctttattgcttttcaagctcctctagaactcaagtttaaaagcccatatctgtaaagtgttttgaactacagtaatatttctttaatatccatccaccttttatagttcaatttcttaaaaggctaacccagaggccaagttgggtggatcacgaggtcaggagatcgagaccatcctggctaacatggtgaaaccccgtctctactaaaaatacaaaaaattagccgggcgtggtggtgggtgcctgtagtctcagctactagggaggctgaggcaggagaatggcataaacccagaaggcggagcttgcagtgagccaagatcatgccactgcactccagcctgcgcgacagagcaagactccatctgaaaaaaaaaaaaaaaa

SEQ ID NO: 14874 - DNA, 1947 bp, Homo sapiens
cgcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccagatactcacagatacgaggttttccgcttgaagtgggagaatatgtgcattcttttcaatgatcacaagactctaacaaaggggatttttaatctttaattttcaagatggttaaaatattgaaatgtttaagtggataactatattattcataaaatgactgagtgaaaactaatatactatgagatgaaaa

SEQ ID NO: 14875 - DNA, 3113 bp, Homo sapiens
gcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccaggtaccttggactcagttgaagtttataaccctcattcagatacatggacagaaattggtaacatgatcaccagtcgttgtgaagggggcgttgctgtgctatgaaatataaagcataacagagcacaaggaacattttgaaaatgcaggacctgaccttttgcaaagcaaacatagatttggtgataagaccctctgattctgtgagttttccatgtatttggtagataaatgactaacgaggctgggcgcagtggcctcatgcctataatcccagcactttggaaggctgaggcagaaggatcacttgagcccaggaatttgaggttgtagtaagctacgatcatgccactgcactccactctgggcaacagaatgagatcctgtctcttaaagaaaaaaaataaactcaagaatgatttttctaaaaatatgagtgagaatggatatggaatatatcccaattaataaagagctcacacagatttgccaggtttactaataatagaaatgccatttatgctgtagaattctccagtttaagtgtagacaactcctattttacaaatttgtagaaattatttactagaagcttcctggcaaatagtccctttagctacttctccagtgcagtataaattgtaacataaaactttatgtgatataggaatagtgtcaatgacacagtttaaagacctctatattcacaattatatccagagcataattttccatggccatagtttgagccacagagaaagccaatgaaatagattcctacttttatttaatgccaagagttttcactagccccaaactttttattggcagcagatatcctaggaggggtgtttgggaaatatctagctattttaatagatagatacctttttgcttgatgataagtttttgcttgctcatattttttgtcttgatcctgagaatgcaagtaaggaattaataggaggttcttagtgaccagatgttgtaatgggctatacagtccagcaggcagtatgcacctagaaatttctcccttttttaggctgggcatggtggctcacacctgtaatcccagcactttgagaggccgaggtgagacgggaagatggcttgaactcaggagttcgagactagcctgggcaacgtgatgagactccgtctctaccaaaaaatatataaaaattagccgggcgttgtggcttgtacctgtggtcccatctgcttgggaggctgaggttgcaggatcacttgagcccaggaggtcaaggctgcagtgagccaagattgtgccactgcacaccggcctgggtgacagcatgagaacctgtctcaaaaaaaaaaaaaaaaaaagaaaaaa

SEQ ID NO: 14876 - DNA, 4151 bp, Homo sapiens
ttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacatcttggtctgtgatgtcttcattgcacctccatcttccatttctgggcctccacaaaacagtaagagtaacagccacagataaagcacctaaaggccaaggtgggaggattgattgcttgaggccaagcgttcaaaaccaacctggccaaaagcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactg

SEQ ID NO: 14877 - DNA, 3841 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaa

SEQ ID NO: 14878 - DNA, 3877 bp, Homo sapiens
ggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagtt

SEQ ID NO: 14879 - DNA, 3569 bp, Homo sapiens
cttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagcagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaa

SEQ ID NO: 14880 - DNA, 4057 bp, Homo sapiens
agccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggaaatgaaagctcttcagtagcttgtttgggtcatgcagctggtcagtgagatctctaggaattctgacccagagactctgagcccaaagcttatgcttttcatcaccatcacctgctacctaccaggatgagggaggagtgatggaaatagcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtc

SEQ ID NO: 14881 - DNA, 3568 bp, Homo sapiens
aagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtg

SEQ ID NO: 14882 - DNA, 3361 bp, Homo sapiens
agccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgggttgtggtctcctgaacagaagtctgtctccaaacacaaatcaagcagcaagatcatctgctgcagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagcagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtcaggaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtg

SEQ ID NO: 14883 - DNA, 3742 bp, Homo sapiens
aacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtctgtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtc

SEQ ID NO: 14884 - DNA, 3541 bp, Homo sapiens
aaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgtattgtgcattgaagggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagcagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtg

SEQ ID NO: 14885 - DNA, 5415 bp, Homo sapiens
gtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataattgaga

SEQ ID NO: 14886 - DNA, 1982 bp, Homo sapiens
acgtgtgaccttgcgacgcgtgttgcgctccggtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggaccctgctgagccctcagcccaaactcctttgcctggcttcaaagacttcctgagctggcctgtttttcctgccttaccccgtctattctactatttataaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtgtgagaagagctactaaggccttaggcattggctggcccacagagggtgtgagacaagctgccaccagggactgagggaggcaggatggagcacattgtctttgctgtgtcatcaacatggcagaaggcacagaagaatcaacattctctgtagctgataccaaaactgatagcaaaacccatcctttattacctctttttttttttttttggagacagtgtctcactctgtcaccca

SEQ ID NO: 14887 - DNA, 820 bp, Homo sapiens
gtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgc

SEQ ID NO: 14888 - DNA, 974 bp, Homo sapiens
ggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaagagtcttgctgtgtcacccaggctggagtgcactggtgcaatctcggctcactgcaagctctgcctctcagattcaagcgattctcccacctcaccctcccgagtaggtgggactacaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 14889 - DNA, 832 bp, Homo sapiens
cgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttc

SEQ ID NO: 14890 - DNA, 611 bp, Homo sapiens
gacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 14891 - DNA, 787 bp, Homo sapiens
ccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatgg

SEQ ID NO: 14892 - DNA, 1071 bp, Homo sapiens
gtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaa

SEQ ID NO: 14893 - DNA, 852 bp, Homo sapiens
ccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttg

SEQ ID NO: 14894 - DNA, 816 bp, Homo sapiens
cggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaacggtacccaaacaggcaaacaacagctggatctgaacgcatgctatcacaaaacgcatcacagagatttggggctggcttcattggaagaggcagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 14895 - DNA, 833 bp, Homo sapiens
ggtttccaggaagtgacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctcctc

SEQ ID NO: 14896 - DNA, 848 bp, Homo sapiens
gagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagagtacgtttccagtattcttattcttatggtatcctatgttgatcttggtcaacagtgcagtcttggtggtcatgatctgttccacctatgttgaacactgtgttagaagtctggggctagaattattgatgcctgctgaatccaaggtttggttaatcccgcttcctcaactgaaggtctggaccctggcattgatgcccatgtcctatctcccactgtgtggttttagaattatatgtccaggtatcagggtactggcccatgccttctgcattattgatatagatgggcagaagcaataccagcttctaagccttgccttctcataagacttatatcagaaaagaaagaagttttctagataaaggtgctgtgaaggtagggccacccagtttcctactcccaggggcggaagctgcattcatgtcatagcctctgtgatgctgtcctctggaatagtgcatcgcacagcctgtgcaaccacacacggcacacccagtggcctaattaggtttgactaagttgacagagaaaaacaggttcagggacattttcatctaggagaaagaatggatacaataaacatttgggatgttc

SEQ ID NO: 14897 - DNA, 3203 bp, Homo sapiens
atgaggggcggggctgcttcccgaccaccatttccacagaggcagggcaagaagagggccacaggtgacgtcattcaggaaagccgccctgattggagggaaggaggcggagtctagtttccctggtgacggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttctaagaagctttcactaatcattacctatgttaaagctcccacctggtggctcatttttcatagcattccttgtgtaagccaaggtatatgacctgcgttttctgcagatgctgctgctgtcacaacatgaactgctgacacagtcctttaccttgctccacctctgcagtgatcataagtgctttgtgcccagaggccactgaagatggtaggcaggattctttccaagaacccaaactgcctttgcctcagctttatggttacctaaaattgccactttttttaggttaaaaaaaacttcagtatcctcattaacatttgaagttggtttcttatgaatatttcgtggctaaaatgattttatagggaatctatcttctaggatctaagccactaaataaaaggataaatgaatgatgataagtcagtcactcatgtttgactctgttcttagaatgaagagaaggtgcatatgcatgtctcaatttctacctttttctgtggtatcggctatactagggaaccattttgtagaagaaggaacgatgacaggtcgcatgaagatcagcctctagtactgatgatctttacttatgcatcttcctgagcaactttctaggctaggatttctaaattggtgaaaaaagcagcattagagtgccagaattagcactggggaaaactggccaggggaacacaaagcaggagacagcctgcgttaattttttttttttaataattttcaaaagcagtggtagaaaatttgataagaatgctttatgtttaggacaacaaaaataattttaaaaagttattttttaccctaatacttttctccactgaatattattatttttttcttagctttttctttctagatgtattccccaacatgctcacatacacagatctttccctttccttactagacctctctttagtttaagataagtttagacaggagaaagtgtatgtaaactacctgaaaggatgacaatcaatacaatgacaaatatgccagtttatttaatttgtttaaaaaaaaaaaggcagaaaacccaccatgggaaaataagcattttttaaaatctgaagttgctcttttcctgtgtggtctttgggaggagtctaatacaaaaactgaaaacctttggtcctgggaatttattttcatggctgttgtcatggctgagtagttttttgatgaattcaatcaatgcagagaacgcttttagataaatcagaactctccttaaaatgcatttcaatcagaagcaaagtacacccattatttatgcagacatgtaaaaaatctaaaaattcttgcaatgagtagtataagccacctatttttacttccttctctgaaatattccagttaactcagcttgggttctgtgctcctcctctcttcctatagaacactgtgcataccttgaataaagagcttattatacta

SEQ ID NO: 14898 - DNA, 4306 bp, Homo sapiens
gcgcatgcgcgaactcctggcgggacctacgcggtagaagtttctactaagtgaaaaggaagagcgagggattcttttctctgtggtctacagcagcagcactattattaaaaatatttggaaagacaacctggcaagttttgaaaaagatttttttaaaaacggtagggttccgctcacagtgggaggcggggctcagtggtccagaaacgcctcttcagaagagggcgggctcgccgagaggcggggtctcgggcccactcggatgacgtgccgcgtagaagtatcgcgggaagaggaagggagcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaacaa

SEQ ID NO: 14899 - DNA, 542 bp, Homo sapiens
attgtcgctcctgcgcatgcgcgaactcctggcgggacctacgcggtagaagtttctactaagtgaaaaggaagagcgagggattcttttctctgtggtctacagcagcagcactattattaaaaatatttggaaagacaacctgctcatcagccatcattaatgttagtgtattttatgtgtggcccaagacaattcttcctccaatgtggcctagggaagccgaaagattggacacccctgataaagtaaacggccatactgtttgctgtggctaagcctttgagtccgtgcctggaaatgtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggt

SEQ ID NO: 14900 - DNA, 4044 bp, Homo sapiens
tgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaaatctggtccttcatcagaactaggaaagcactgatttaaacatttggtcagacattttaaattgaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttct

SEQ ID NO: 14901 - DNA, 610 bp, Homo sapiens
atcgcgggaagaggaagggagcgtaactcttagaagtcactatggtgacggggaggtaccaggtatttgagagcaatcgccaccgctttcctggaacttgaggctggagtgcagtggtgtgatctcggtttactgcaacctccacctcctgagttccagcgattctcctgcctcagcctcctgagtagctgggattacagtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattag

SEQ ID NO: 14902 - DNA, 3073 bp, Homo sapiens
actcggatgacgtgccgcgtagaagtatcgcgggaagaggaagggagcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatatccttttaatgcttataaatcttattggattttcttaattatagtattgttaaaagtttctctattttatatcctagttgaagaatagattttttttttcattcctttagtggctgtttacctaaattgttttaaagtatttaagatcatgtgttaaaaatctggtccttcatcagaactaggaaagcactgatttaaacatttggtcagacattttaaattgaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaa

SEQ ID NO: 14903 - DNA, 719 bp, Homo sapiens
tgcgcatgcgcgaactcctggcgggacctacgcggtagaagtttctactaagtgaaaaggaagagcgagggattcttttctctgtggtctacagcagcagcactattattaaaaatatttggaaagacaacctgtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaa

SEQ ID NO: 14904 - DNA, 1297 bp, Homo sapiens
catggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacgtcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaaattgagttaccaagctcagcccacactcatggggagaggaattaa

SEQ ID NO: 14905 - DNA, 3141 bp, Homo sapiens
acatggcctctgccccttcccaagcagaggcaacatggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacgtcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaagttcctcttcctcgtctaaggaacatgatagaaaatgtcatccaaaccttaaaatttatgtatggttctttagatagtgccttttgccagattgagaatgttcctcgtttggatcatttttttaacttgttctttcaaagagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgtccgaggattactatgacatgaggcggctgtatacaattttggggtcttctctattttacaagggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgatt

SEQ ID NO: 14906 - DNA, 2968 bp, Homo sapiens
cttttgaggggctcggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaagg

SEQ ID NO: 14907 - DNA, 3709 bp, Homo sapiens
gccgaaagcctcgggcggccttttgaggggctcggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagaggtgagacagctggcgatgagcggtgtgcaaaggggaaaggcttcgtgaagcagccctcctgtatcagggtggctgggcctgatgagaaaggagaggactccaggcgggcagctgcaagccttccaccgcacgatagccactggaagcccagcaggcggcatgacacagaacccaaggccaaatgtgccccccagaaaaggcgcactcaagagctcagaggaggaaggtgctctccggctggttctagccgccctggcagtgcccggggggaggcggtccatgctgggcagaatcctccccaccatcgtacaccaagaaacaaagtgacacaagccaagctcacaggagggctctattcacatttgccacagagcacagaggagttgaggtcaggagctaggaggctggagacatctaccctgtccgaggactttcaggtatctaaggagactgatccagcacctggtcccctctctgggcagagtgtgaatattgaccttctccccgtagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaaggctgattcacctaaaaatgtgttaactgaaagaaaatgtcagaatgtttcctttctgctcttacacagcattgttttgtcaatcaacacagcctgcactgaaaggacctgcatagactatgtctgtgcaaagtgcctgagtgtctgctttcacctcagtctgtacagttggaaatgagaattcataattaacagcaaaatctaaggaaaacta

SEQ ID NO: 14908 - DNA, 1654 bp, Homo sapiens
cggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaaggcattgagaacaatcagcacaggcaggatctaagagactacaatcattcaaagaagagaaacacgtaaagtgagtaccacattcatcctggccttttcctttatgacattttccaaactggaatgcaaaagaatacaaccctaacaggaagcagcagccttaccaggctgaagaaactgaggcagagtttggagataatagtggctggaacttgaaagtcaaaatcctggagaggagggaattgcagagaaagaatgcaagaatctggatacaaattcctcacaagtttttaacagattcctaaactgtgcttgtatagggtggtgctctaagaaacctagtattaaacaacagctgggagactagacagctgagtagagattattttaaattatcctatattttcttttatgtttaaatctcttaatatataacacattgatttttgtatggggatccattctcattttaaagcatatggataactaattttcccaacacaacctagttcattaatttttggccatttagtatctgctctctgtcagttccaggcttttgtactacgaactccctatgcatttctgtttttttaaatgagggatcctgaatactagggagcctttgggaaatttgaaaataaaagttacatgatcagtgtattttagggggactaatatggcaactaaagctactttggaagagaaagagtggagatacatagattgctattatagttcaggccaatagagaggaattgggtttaagagatacattatggaggcagaagtgttcattcaacaagcgtttgttaaatatctactatgtaatcatgattatacaactagagagaatatgaaaaaaatgaattacgtatgttagcttatagatggatgctctcagtacccatccctattaatcgtcatttccctttgtttagtgaaccttctgatatattggatatcaaatatcctttccaagtattgtctgtcccacttaattctggtatccatgaatgcagaagtgtgctatttatgtaatcatgaacactcatgtatatgtgtataccttcattcattcaacatgtgttaaaactattatgtaacaggcatcatgttaggccttggaacacaaaggtgaacaacatgattcctgctcttaagttgcttacaaagatcatggatgaagatattaaatgataattaaagctgattgatctaccttgtaa

SEQ ID NO: 14909 - DNA, 3655 bp, Homo sapiens
aaagcctcgggcggccttttgaggggctcggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagttttcaaggtacgctgtttccatgttactgatttacaaaaaggagaaagaatacctctgaaacttttcaggaacacttataccagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagaggtgagacagctggcgatgagcggtgtgcaaaggggaaaggcttcgtgaagcagccctcctgtatcagggtggctgggcctgatgagaaaggagaggactccaggcgggcagctgcaagccttccaccgcacgatagccactggaagcccagcaggcggcatgacacagaacccaaggccaaatgtgccccccagaaaaggcgcactcaagagctcagaggaggaaggtgctctccggctggttctagccgccctggcagtgcccggggggaggcggtccatgctgggcagaatcctccccaccatcgtacaccaagaaacaaagtgacacaagccaagctcacaggagggctctattcacatttgccacagagcacagaggagttgaggtcaggagctaggaggctggagacatctaccctgtccgaggactttcaggtatctaaggagactgatccagcacctggtcccctctctgggcagagtgtgaatattgaccttctccccgtagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcaggtaaggcagccactgcaaagcagatggtggggaagaacatggggaagcattttcctttgtttcatccccaaagacagaagacattagaacagatatggccagggttttccaatggtcatttgatttcatgggattattactgtagccaacatctgtctccctaagaggcaaattattttcacaactaaaagctattattgttaacattaactccaacagaaataaatggtagctattattgatcacttttacacattttttcacacaaaggaaataaatgaaaatactgtcactcttc

SEQ ID NO: 14910 - DNA, 4648 bp, Homo sapiens
cgccccgcgcccgccaggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcgagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 14911 - DNA, 4672 bp, Homo sapiens
gccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcgagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacct

SEQ ID NO: 14912 - DNA, 1689 bp, Homo sapiens
aggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaa

SEQ ID NO: 14913 - DNA, 2153 bp, Homo sapiens
tcagcactccaccaaagcctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccacagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatccta

SEQ ID NO: 14914 - DNA, 2015 bp, Homo sapiens
agcactccaccaaagcctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccacagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatcc

SEQ ID NO: 14915 - DNA, 7513 bp, Homo sapiens
gaagagttctgcactttgttccttccctggcacacctgtgtctgcattccttctatctcccggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtaaataatggaatcaccatgcggcatcagactgcgaggcaccgccacctgattgagggtcctggaagaagcagcgaagcctgcagcaagctcagctcacaaggctgcccagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggccccccaagggagtggcagggagatggcgcccctgcttttccctgagcctctcgcctgctcctcttgggtctcttggctgctctttctccaggtgtcaggtcccctcattgctcttctcaggtggccacactatgtcaagaagcctctccacactctgtggcacttccagtcccataaatcctgtttcttatccactttggaaatgcatgaacactttacaaagaacatgcccgggtttttacattttaaaagttattctagacaatcactattggcttttttcttttatttttaaaaaactcacatagaggagacaatcagaaatttaccatagtcccaagaattcagctacatgatgactcgaatttaaatttagattaatcaaatggtctcctgttctctgatttctggtggcttttagacactaatttttgagaactacttttttttttttaccaaacttcagggacactctgctagttttgaataagtaaccatcaaagttactaaaacatggccaggcgcagtggctcatgcctgtaatcccagcactttgggaggccgaggtgggcagattgcctgagctcaagagttcgagaccagcctggccaacatggtgaaaccccatctctactaaaaatacaaaaaattagctgggcatgcacttgtaattccagctactcaggaggctgaggcaagagaactgcttgaatccgggaggtagagattgcagtgagtcaagatgctgagatgccaccactgcactccagcctgggcaacagagcgagaacctgtctcaaaaaaaacaaaaacaaagttactaaaatgtcaccttcacagaacaggacagggtacccttgggtcgcacgggcctggctggcatgtaaacggtcagttgcactgcctagtggtttggtagatctgacttgtaagcagttcatagaagctgctcaatactcaagaatcttgcaagacagttattaaacattcatagcttgaaattgcccatggtgggagagtttacatcacaaccactacaaatcagcacttgctttcttcttcttaaagagagctgcttaccatacatagcacccacagtgtctcccttctcttctaccccaacccctgaaacacactgacccctattctccagatgacagcacagctgtttgggactgatagggtcacagttgccaggttgggaatgctagatgtagtcttcacccatcaccttctgtcgtcctcccaggggtgtcatatttacagaggcaaactcttacagcttggatgatttctcatcaagcaactctactcacctctttttcccctttccctgtgcgtttcttcttcttgtcctcattttccttgagaaaactctctctataaaaaatttccatagagtatgtggctgataaacaacagaaatttgtttctcacagttctggaggctggaagtccaaggtcggggtgccctcatggtcaggtgctggtgaggaccctgatctgggttgcagactgctgacttcttattgtgtcctcgtggtagaaagagggttagagcctctggcatgccttttataagggtactaatcccatcatgaggccccgtccttatgacctcatcacctcccaaaggaccccctcctaataccatcacattgggggttagggtttcaacatatgaattgcgggggacacaaacattccgtccatggcacctacttcatagggtttggcatgctgctcggtacatggttaacattcataaatggtgggggcccttactgtggtagaaaccattgtcactgcaaggcagccctgcttgggattcaggtgaacaaatgtaacgtgggtgggtgagggactccctcctcttcagagaagccctcctgtggctcaggggcagctgcagggccagatggagttggcctgcagggagtcagccttaccccatcagagaccaacttgaaagatttttttctctgtgtagttcgtgttatcaatctgatctgcagccaggttatttacttctgaagcattggagttatcgattgccattgccccatggttctcactctttgcaggcactcttcaaatttttattttaaaaattataatgcaaacatctggccatcaccttaaccaagtgacaaagtcctagcacaccattaatggtaggataactgacattaagtgttcctgctgggatgaattatgaagtattccttccaaagatgtcaatggaaactaatcgagtcttacacctaattttcagtttacagtaaatacagaggataaagaagttaatggcatggtggaataaccaaaatgtgtatcattctacaaaaaaataggcctggactatttaaggagtgagtgtcactgtgggaagaataagagggggactgtcttgtccttgctactcaaagagtggtcctgggcctgtatcatcattgggaccacctgggcgcttgttagaatcaaagactctcaggcctcacctagacatccagaatcaaaatctgcattttaacaagatgcccaggtgatctgcatgcctgttaaagtctgagctctgttgcagataaccagagacccaacaaccaaaggcaaagcgtaagccttgattggattttggtttaggaaaaatctcataggtataaaagacaactgggaatgttgaatgtggatctggtggtaggtgatattgttagtgatgtgagtgatgcctgctgaagtactgagagatgaagcatcatattgacaacttactccaggaaaaaaggtgtgtgtataggtgtgtgtttggagagtgtgagcgagaactaacatggtaaaatgttaggtggagcatatacagttctcattatactcttattttaaatttatatttgaacacagtcaaatctgaatggaaatacatttaaataagcatttctttcagtcatataagtaatttgcctaaaaatgccctctaagtccatcattaggttaagcgatttactgaaggtgcagatatcatgcttatttcattgggttgttttggaatgtcccccacttggagagtttgaggaatggaaatgagaatcggaggagaaataaggccagaggctcacattgcttgcagggaaccgactgagtaatgaagaagaggaaggaagcccttggaaggaacgtaaaatccatttcagcctgccgccccttggaatggagggtcttctagggaccagaaacaccagacacttcttctgccccaagcacaccccacactaatttctgctgcagcatcacgatcagggcaaatcagcacagccccccagccatcagtggtgtctagaaaagtaaggataattttcttccttctcactgcagccccaagctcttattaaccttcttttatgtgttcattaaatgcagtcatgtgacaactgtgttcaaagttagaaatagtggtcggggaggcttatagatcctcttgctgttctgaggccttaaaaccaaaaaaataatggaatgattgcatcactgcgaggaagtatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaacttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctatgaaaggaagagtgacttctctgctgcatgatattgggggtaaatagttattgcacatttgctcaaaccccagcaaagtgcaccccattttaagccaaatttacaaacttacaaagatgatccaccaatagttttctctatttactttattcttgctctgtcacccaggctagaatgcagtggtgtgattatagctcactgcagcctccaacttctggactcaagtgatcctcccaccttagcttcccaggtagctgggatacaggtgcacgccaccacacccaggctagtttttctaaatattggagttcccaaagagtattcaaactgatgtgatattttaaaagacattttgtaagcatcttttaggaatatcagtaagtggaagaaaaacacatagttatcagtggatattatgccagagaggcatgagaaatataattttattttgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcccagcagggtagtggagggaatgggctgacgcatctaaggctgatgccaggtctgctccctatctgggtggcctcagcaaatgacgtccagcacatccaggggcaggctcaagggagaacagcccccaaagctaagatcctgccaagctaaatacagtagttctaatgaaatgtgagaggctataatcccatttgggaaattcctaaaaagtcatgaggcaggggattggtttatgttattatcatgacctgagagtcatggctcagagccaaatgttcaggattgaattcaacagcatttaaatgtctttagagcaggatggaaatatgttagcaatgcctgcagagtgccaagtaaacgcaaaagccaatgagatcataaaggaagttgttagctaacctaggtggagtcgccaacttccttctactctaataattaaaaataaaaataatacttgggaggtaactggaataaaggttctaaaatcaaaaccctctgaagggtgaaaactgggagcctcctgttcccatagtaaccacagcactcagggcactgtctcccagcgctggagtactgtcttatgaccagagatcctaagcaacctctgctcatctgagttgtccaccatattgtgggcatgagtccttgacaatagtaaatagcacctctgttcccttattgggtaaatgattttccaactctgggaatgtgtagaattcattatggaaataatgcaataattcaaatccataatattgatactttcatgttaagtttaggactaatcttgtgtatgctccttaagtgatttgaatctttaaaaagcttatgattccaatttgaaatgtgaaattgattttacgtttgtgatttgaagttgaaaggtataagaatatttaacttagctcatgaaaagtattagactagatttactataagtttaatgtattagatttacaagagatgcttaaatatatgagaatgttttgtcttaattggttataatcttgtcatatcaatgatttgaagtgctaaaatagaaaattaaatatgataaattacacaagaagtttagaatgtttaaaagattttaataaacaaagcctataactaag

SEQ ID NO: 14916 - DNA, 8742 bp, Homo sapiens
gaagagttctgcactttgttccttccctggcacacctgtgtctgcattccttctatctcccggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggccccccaagggagtggcagggagatggcgcccctgcttttccctgagcctctcgcctgctcctcttgggtctcttggctgctctttctccaggtgtcaggtcccctcattgctcttctcaggtggccacactatgtcaagaagcctctccacactctgtggcacttccagtcccataaatcctgtttcttatccactttggaaatgcatgaacactttacaaagaacatgcccgggtttttacattttaaaagttattctagacaatcactattggcttttttcttttatttttaaaaaactcacatagaggagacaatcagaaatttaccatagtcccaagaattcagctacatgatgactcgaatttaaatttagattaatcaaatggtctcctgttctctgatttctggtggcttttagacactaatttttgagaactacttttttttttttaccaaacttcagggacactctgctagttttgaataagtaaccatcaaagttactaaaacatggccaggcgcagtggctcatgcctgtaatcccagcactttgggaggccgaggtgggcagattgcctgagctcaagagttcgagaccagcctggccaacatggtgaaaccccatctctactaaaaatacaaaaaattagctgggcatgcacttgtaattccagctactcaggaggctgaggcaagagaactgcttgaatccgggaggtagagattgcagtgagtcaagatgctgagatgccaccactgcactccagcctgggcaacagagcgagaacctgtctcaaaaaaaacaaaaacaaagttactaaaatgtcaccttcacagaacaggacagggtacccttgggtcgcacgggcctggctggcatgtaaacggtcagttgcactgcctagtggtttggtagatctgacttgtaagcagttcatagaagctgctcaatactcaagaatcttgcaagacagttattaaacattcatagcttgaaattgcccatggtgggagagtttacatcacaaccactacaaatcagcacttgctttcttcttcttaaagagagctgcttaccatacatagcacccacagtgtctcccttctcttctaccccaacccctgaaacacactgacccctattctccagatgacagcacagctgtttgggactgatagggtcacagttgccaggttgggaatgctagatgtagtcttcacccatcaccttctgtcgtcctcccaggggtgtcatatttacagaggcaaactcttacagcttggatgatttctcatcaagcaactctactcacctctttttcccctttccctgtgcgtttcttcttcttgtcctcattttccttgagaaaactctctctataaaaaatttccatagagtatgtggctgataaacaacagaaatttgtttctcacagttctggaggctggaagtccaaggtcggggtgccctcatggtcaggtgctggtgaggaccctgatctgggttgcagactgctgacttcttattgtgtcctcgtggtagaaagagggttagagcctctggcatgccttttataagggtactaatcccatcatgaggccccgtccttatgacctcatcacctcccaaaggaccccctcctaataccatcacattgggggttagggtttcaacatatgaattgcgggggacacaaacattccgtccatggcacctacttcatagggtttggcatgctgctcggtacatggttaacattcataaatggtgggggcccttactgtggtagaaaccattgtcactgcaaggcagccctgcttgggattcaggtgaacaaatgtaacgtgggtgggtgagggactccctcctcttcagagaagccctcctgtggctcaggggcagctgcagggccagatggagttggcctgcagggagtcagccttaccccatcagagaccaacttgaaagatttttttctctgtgtagttcgtgttatcaatctgatctgcagccaggttatttacttctgaagcattggagttatcgattgccattgccccatggttctcactctttgcaggcactcttcaaatttttattttaaaaattataatgcaaacatctggccatcaccttaaccaagtgacaaagtcctagcacaccattaatggtaggataactgacattaagtgttcctgctgggatgaattatgaagtattccttccaaagatgtcaatggaaactaatcgagtcttacacctaattttcagtttacagtaaatacagaggataaagaagttaatggcatggtggaataaccaaaatgtgtatcattctacaaaaaaataggcctggactatttaaggagtgagtgtcactgtgggaagaataagagggggactgtcttgtccttgctactcaaagagtggtcctgggcctgtatcatcattgggaccacctgggcgcttgttagaatcaaagactctcaggcctcacctagacatccagaatcaaaatctgcattttaacaagatgcccaggtgatctgcatgcctgttaaagtctgagctctgttgcagataaccagagacccaacaaccaaaggcaaagcgtaagccttgattggattttggtttaggaaaaatctcataggtataaaagacaactgggaatgttgaatgtggatctggtggtaggtgatattgttagtgatgtgagtgatgcctgctgaagtactgagagatgaagcatcatattgacaacttactccaggaaaaaaggtgtgtgtataggtgtgtgtttggagagtgtgagcgagaactaacatggtaaaatgttaggtggagcatatacagttctcattatactcttattttaaatttatatttgaacacagtcaaatctgaatggaaatacatttaaataagcatttctttcagtcatataagtaatttgcctaaaaatgccctctaagtccatcattaggttaagcgatttactgaaggtgcagatatcatgcttatttcattgggttgttttggaatgtcccccacttggagagtttgaggaatggaaatgagaatcggaggagaaataaggccagaggctcacattgcttgcagggaaccgactgagtaatgaagaagaggaaggaagcccttggaaggaacgtaaaatccatttcagcctgccgccccttggaatggagggtcttctagggaccagaaacaccagacacttcttctgccccaagcacaccccacactaatttctgctgcagcatcacgatcagggcaaatcagcacagccccccagccatcagtggtgtctagaaaagtaaggataattttcttccttctcactgcagccccaagctcttattaaccttcttttatgtgttcattaaatgcagtcatgtgacaactgtgttcaaagttagaaatagtggtcggggaggcttatagatcctcttgctgttctgaggccttaaaaccaaaaaaataatggaatgattgcatcactgcgaggaagtatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaacttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctatgaaaggaagagtgacttctctgctgcatgatattgggggtaaatagttattgcacatttgctcaaaccccagcaaagtgcaccccattttaagccaaatttacaaacttacaaagatgatccaccaatagttttctctatttactttattcttgctctgtcacccaggctagaatgcagtggtgtgattatagctcactgcagcctccaacttctggactcaagtgatcctcccaccttagcttcccaggtagctgggatacaggtgcacgccaccacacccaggctagtttttctaaatattggagttcccaaagagtattcaaactgatgtgatattttaaaagacattttgtaagcatcttttaggaatatcagtaagtggaagaaaaacacatagttatcagtggatattatgccagagaggcatgagaaatataattttattttgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcccagcagggtagtggagggaatgggctgacgcatctaaggctgatgccaggtctgctccctatctgggtggcctcagcaaatgacgtccagcacatccaggggcaggctcaagggagaacagcccccaaagctaagatcctgccaagctaaatacagtagttctaatgaaatgtgagaggctataatcccatttgggaaattcctaaaaagtcatgaggcaggggattggtttatgttattatcatgacctgagagtcatggctcagagccaaatgttcaggattgaattcaacagcatttaaatgtctttagagcaggatggaaatatgttagcaatgcctgcagagtgccaagtaaacgcaaaagccaatgagatcataaaggaagttgttagctaacctaggtggagtcgccaacttccttctactctaataattaaaaataaaaataatacttgggaggtaactggaataaaggttctaaaatcaaaaccctctgaagggtgaaaactgggagcctcctgttcccatagtaaccacagcactcagggcactgtctcccagcgctggagtactgtcttatgaccagagatcctaagcaacctctgctcatctgagttgtccaccatattgtgggcatgagtccttgacaatagtaaatagcacctctgttcccttattgggtaaatgattttccaactctgggaatgtgtagaattcattatggaaataatgcaataattcaaatccataatattgatactttcatgttaagtttaggactaatcttgtgtatgctccttaagtgatttgaatctttaaaaagcttatgattccaatttgaaatgtgaaattgattttacgtttgtgatttgaagttgaaaggtataagaatatttaacttagctcatgaaaagtattagactagatttactataagtttaatgtattagatttacaagagatgcttaaatatatgagaatgttttgtcttaattggttataatcttgtcatatcaatgatttgaagtgctaaaatagaaaattaaatatgataaattacacaagaagtttagaatgtttaaaagattttaataaacaaagcctataactaagactgatgctttaagggagtttggcttattcaacttgagttaatcaaacattaattaaagccccccttccccaaagagatttgttttatttatttgtttactagttttataaataggataataaaatgtgtgtatgaggtcagaatgcttttgacagaagtaatacaaacaaaaaaacctcactataacccaaacaaataagggattatttttccctcctagtgagaagtctggaggtagatattagatgctggtctattgcttcaatgaagttagtgccaaagtctcagtggttctcttggtctttcttcataaccaccggatgctgttatagcttcaccaatcacaacaagcacagtgcttggaacataataggtgctcaataaatattcagtacatattgaatgtgtgcagaaatatatctcaatctagtcataaaattttagaatgcaagatctgaaagggacatgggaatctgtgtttttaacgtgttccaggtgattctgctgaccaggtgagtatggtaaatgtggcaagtattctcaagtgagctcatcagtcccagggctgttagcaccttccatctgccaggccctccctggtctagaccttcagccttgaccttgccctgaaacgccaaactcttactcccagctgctttctctgtccctccacttagatgttagtaggcaccacaaccttttaatgctcaaaatactacttttgagtcctttccaccccttacttggcccctcaattcatactttttgggatggagcctcaaatccagaaatcttctgtattagtccattctcacactgctaataaagaatacctgagactgagtaatttataaaggaaggaggtttaattgattcacagttcagcatggctggggaggcctcaggaaacttacaatcatggcagaaagaaaagcaaacatgcccttcttcacatggtgacaggaagcagaagaatgacaactgagtgaatggggaaaccccttataaagccatcagatctcatgagaactcactcattctcatgagaataacatgggggaaactgcccccattattcaattatcccccatcagttctctcccatgacatgtggggattatgggaactacaatgcaagatgagatttgggtgaagacatagccaaaccatatcatcatcttaaatttctgtgattcttttattctgcacatccaaatccatgagcaagttatactgactttatctctgaatattgaccatgggaggggaacaaggagaagcagtgtgaacaggaaaagcatgctgcctgctgctgtgaataataacatatcttgctctga

SEQ ID NO: 14917 - DNA, 1180 bp, Homo sapiens
gaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtaaataatggaatcaccatgcggcatcagactgcgaggcaccgccacctgattgagggtcctggaagaagcagcgaagcctgcagcaagctcagctcacaaggctgcccaggtttctactgctagagacatacaaaattcagtatggagtaaaagctatgtcttgaaaaggaccaagatataaaatgacactaaattaaggtgtaaatattttctcaaaaaagtttaagacttggccaggtgcggtggctcacgcctctaatcccagcactttgggaggccaaggcgggcggatcacgaggtcaggagatcgagaccatcctggctaacatggtgaaacccggcctttactaaaaatacaaaaaatgagccaggcgtggtggcgggcgcctgtagtcccagctactcgggaggctgaggcaggagaatggcgtgaacctgggaggcggagcttgcag

SEQ ID NO: 14918 - DNA, 882 bp, Homo sapiens
ggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtttttggaaaaattatcctgaaggagctggcattgatttccttcctgaatctgtaagcagaatgcaggtctggtgactgtcactaccactcctctcaactgtggccctcgactga

SEQ ID NO: 14919 - DNA, 2158 bp, Homo sapiens
gaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtaaataatggaatcaccatgcggcatcagactgcgaggcaccgccacctgattgagggtcctggaagaagcagcgaagcctgcagcaagctcagctcacaaggctgcccaggtgcctctgcagcaggcagtctttttcactttgccattgagtttgctgccccctagctttcataaggcataatcccgagagtaggttatgattagtgatggaggaaagaaaaatctccatgaagcccgcatctccagtatggtgactgggtctgataagcgcgccatgcatgtcttgtagaggcagcttccagaacttcctggtcaggtttagaggtggtgatctgattggaaaagctggagaggggcaggcggggaagtgtctggaagctactcattgcttttacttagatgtttgttatttggaggcttggaaagaggtcgatggggtaccccttggccactgagtcccctatcaacgggcatcagcatctcactgggtggggatgctctgcttccatggttggctctgtagtcataggaacttgccgtggtggttgttgtttagaatataatatacaagcctttattaatatattaaataccaagagctagtcgtagctctataattttaaagtagtgatgaatgtaatgatattttaaaatatctataacaactgtaaaatgatatgaaaataactgtggatttcattggtgataaagtcatagatattgctaacactactgtggtttgctgcctacatttataaaggaagaaactgctaaatttcagttagatgttagtgaatatgaaaactttttttttcaaattcaagttcatggacctgctaaattcaatccttggccctttgggggtctgaggattccagttaaaaaaatcctgacctataataagaccaaagtactcacatcgagagagtgaaagataaaataataatagaagtcaacttaacattaataatattaataagaggaattgtttaatatggtctgtgtatttgcaggtttctactgctagagacatacaaaattcagtatggagtaaaagctatgtcttgaaaaggaccaagatataaaatgacactaaattaaggtgtaaatattttctcaaaaaagtttaagacttggccaggtgcggtggctcacgcctctaatcccagcactttgggaggccaaggcgggcggatcacgaggtcaggagatcgagaccatcctggctaacatggtgaaacccggcctttactaaaaatacaaaaaatgagccaggcgtggtggcgggcgcctgtagtcccagctactcgggaggctgaggcaggagaatggcgtgaacctgggaggcggagcttgcagtgagcggagatcccgccactgcactccagcctgggcgacagagcgagactccgtctcaaaaaaaaaaaaaaaaa

SEQ ID NO: 14920 - DNA, 4004 bp, Homo sapiens
tccttctagggaagggctggggaggagggggtggtgacacggtggagacaccggctaggccagggggcctgcccttgggacaggtccagacccatggagccccccgggaggagcagcaggtccacagcgtctcatactctacaccagtattgctgtcctactcaggtccttgactccatgaagcttaccccctcaggcaggctggcagagagcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagc

SEQ ID NO: 14921 - DNA, 5980 bp, Homo sapiens
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaatgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcagggaagcgggggcggcgtaacagcgtgggatcgctggacagcaccatcgaagggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctc

SEQ ID NO: 14922 - DNA, 6011 bp, Homo sapiens
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaaatctgatggtgagaattccagaacagtcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcagggaagcgggggcggcgtaacagcgtgggatcgctggacagcaccatcgaagggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctca

SEQ ID NO: 14923 - DNA, 6863 bp, Homo sapiens
atggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccgaaggctcaagcccaggagctgcaggaggaggaggagcggccgggggcaggggctgcctccccaagggctggcccccagcacaaggcctcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccacgggatcgcgaggtcatgtatctgcaaaatgcacctttttaaagagtgtcttagttccccagccccagctaatacccggccaatgccgtgtacgcaccggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccagggacactctcccagacagccctgacccgccaggcaggaccccgtcccctgctcacacagctcttcaaacttaccaaggacaggcaggaccccgtcccctgctcacacagctcttcaagcttaccaagtcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttg

SEQ ID NO: 14924 - DNA, 2701 bp, Homo sapiens
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggtaa

SEQ ID NO: 14925 - DNA, 7094 bp, Homo sapiens
ggaggctgggccggtgggagagggaggcgagccgaccgctgggctgctgggctcccgcgccctcgcgctccccgccgccagcccaggcgcaggcagggcgcaggcggcggcgggcggcatggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccgaaggctcaagcccaggagctgcaggaggaggaggagcggccgggggcaggggctgcctccccaagggctggcccccagcacaaggcctcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccacgggatcgcgaggtcatgtatctgcaaaatgcacctttttaaagagtgtcttagttccccagccccagctaatacccggccaatgccgtgtacgcaccggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccagggacactctcccagacagccctgacccgccaggcaggaccccgtcccctgctcacacagctcttcaaacttaccaaggacaggcaggaccccgtcccctgctcacacagctcttcaagcttaccaaggacaggcagaaccccgtcccctgctcacacagctcttcaagcttaccaaggacaggcaggaccccgtcccctgctcacacagctcttcaaacttaccaagtgccctctcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgagcaaa

SEQ ID NO: 14926 - DNA, 2594 bp, Homo sapiens
cgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 14927 - DNA, 1919 bp, Homo sapiens
ggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaa

SEQ ID NO: 14928 - DNA, 602 bp, Homo sapiens
cgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtagtagccttaaaatagataaataattgtctttttgtgtcaaatttcatgaatttaatgtaaagatgggagaagtgttgaattataggagaaacactcgagaaagtttacagatggtttccataacaggtggtttttcagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaag

SEQ ID NO: 14929 - DNA, 2262 bp, Homo sapiens
gagtggggctgtgggaggaagaaaggctagcgggcgttggccgtatgtgggtgtcttgaggcagtttttcagttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaga

SEQ ID NO: 14930 - DNA, 550 bp, Homo sapiens
gatgttcccgctgcctaaagaatgattgactgtaagattgatttgccaacagtggggtgcttttctctcgatacacacagcaatagacagaacggaaattctgggatcctaatctagcatggaagagaaaggccgggagcacgaaggcagcaggacctcttccttctcttttttctttttctatacttcttttctcccctctacttatttatctctttcaagaaatgagactgggcacagtggctcacgcctgtaaacccagctctttgggaagccgaggcgggaggatcgcttgaggccaggagttcgagaccagcctgggcaacatagtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagag

SEQ ID NO: 14931 - DNA, 1981 bp, Homo sapiens
agtttacttcctgcgtccccggacgccgtaggtggaaaggcgaaccctgagtggaggatgttcccgctgcctaaagaatgattgactgtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgcctttta

SEQ ID NO: 14932 - DNA, 7233 bp, Homo sapiens
gacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtt

SEQ ID NO: 14933 - DNA, 5844 bp, Homo sapiens
cgcggtgaataacggggcctggctggaggagaaaggaaacctgctgcgggaggcggcggcgaccggccagggagcgagggaggagagttcacttttacttcagtgtcagcgcgcggcggccgtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaa

SEQ ID NO: 14934 - DNA, 5598 bp, Homo sapiens
gagggaggagagttcacttttacttcagtgtcagcgcgcggcggccgtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaa

SEQ ID NO: 14935 - DNA, 3376 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcac

SEQ ID NO: 14936 - DNA, 1647 bp, Homo sapiens
agcagcttgtattcttagaaacgcagcagacagcaactttagcaggtgatttcaatcaagtcagctgaaatgcactcacttccaggtgatcggccttggttctgttaagaccatttttggatggggtgttttaaaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggaca

SEQ ID NO: 14937 - DNA, 4208 bp, Homo sapiens
tccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 14938 - DNA, 3903 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 14939 - DNA, 3062 bp, Homo sapiens
atgacaaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 14940 - DNA, 3965 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 14941 - DNA, 1000 bp, Homo sapiens
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagcgaaagatagggttgaatgtaaaaatcttgcaggatcctgaaaacatccaccacagagctgctgtaaatgcgaactatggaatcagtttgccatatattaatcagagaaaagcatgttaggtcctcaaaggtatgtggaaacaagaagaaatccctggtactgttcatgttccctcactgacatccagttccagttagactttataatacaacacattaagaaatctacagaaaatttgactttgatttattccttttaaataaaaagtgtttcttaaaaggcttgaaacatgtatctgttaacatgaattttaaaagaacaattatgaatgcataacaaaatagccaaaccaaacattgctttgaattgctgcacaaataactgattataactgttatgacctagaaaaaaatcataaaaacatttttctttttggcaagatgtgagttgctgtagaattataccagttctttggttctactttccaaataaatatatatataatgcaatgtaaa

SEQ ID NO: 14942 - DNA, 1460 bp, Homo sapiens
tcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgtgagtgtcatgtttctttttctatgtcctgacttgacattcaactgaaagcctagactttggttctaagagagaaatcttgggatgtgagcaggtggtttgtgacagtgaagatctatgtagcttatttgctacccaggaacccatggtgagagttttgtcacctcaaaataaagacacaattcataagcacaaagtgaactttatcaagtctggagaaaatagattgcatttatgtgttctcatttctctattatggaggtatcttttttgcttttctttataatagcatatttcttttagtatgtgctgtgtgtttcttttattgtgtggtgctaatatgatagaagataagattggttataaggagtagaaagagaacttttaccagaagaattgaaagtggtcacacactcaggggttgcaacttaaatgtctccaggggccaggtaagtcaccctcatgactgaggtggctgagctgtgcccctggctacacggagaacatagacctcacctgaagggcagcgcacttggctcctgacaatgtgacaccatgtggcgatacaggcaggcatggccaaatgtgattttctttcttcaggacatgtcagaaatctgcatttttaagtgttagcagccagtaagaaaatttaaaaggtaaagtaagcatgcctacagaccacaattgacctacaggccaccagtttaagaaatctgagatagagagttaaggaataagggaatctgctggaagtctttatttttaaaaaacaccaaaagtgggaagaaatcagtgatgagggatttatgaaccaggattttgtggatttaagcattgtgataatttgtaaccagtcactgaaatgctgaaaagttagagaaatgaagtaattacacaagtatattacttccaaaaatttttcttttacttttggttatcatgtttattctgtggtaaaaaggtttcccaacactcaacgcaatgtattctttttgggatcaggtaaaagttactgtatttgaaatgttttcagatggttgcattgcatattcttcaataaa

SEQ ID NO: 14943 - DNA, 885 bp, Homo sapiens
tcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacaccctttgccagggcccctgttgggaagattcatccttacatctcttggaggttgcagtcacctggggacaagttgcctggtggaaggaaggtgattcttctctaccttgaccagcttgccagacccactgggttcatacatactctcaaggagccccagatagaaagacttggttttctcaccctccagtgaatggacctcaagtttatggagggaataggatgatccctggcctacactgactaagcctgtcatcaagaaatgagcttcctctaacaaccatgagtccatttggaacttctgtgttaaaagccttcagtccaagtcaaatgttgtcagtgagctgtgtccctggggagttctttatgccctgcctcttgcttgatcttttccaggttgttgaacctcagccctctttctctgggtttaatctattgctgttactgcctagacaattttctatcttctcatatctgatcaactgactgtctt

SEQ ID NO: 14944 - DNA, 1408 bp, Homo sapiens
tcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaacattcagcgagcatggcgagagtacctgcagcggcaggagcccctggggaagaggagcccgtccccaccctctgtctcctcagagaagctgagcagctctgtcagcatgaacaccttctccgacagcagcacaccctttgccagggcccctgttgggaagattcatccttacatctcttggaggttgcagtcacctggggacaagttgcctggtggaaggaaggtgattcttctctaccttgaccagcttgccagacccactgggttcatacatactctcaaggagccccagatagaaagacttggttttctcaccctccagtgaatggacctcaagtttatggagggaataggatgatccctggcctacactgactaagcctgtcatcaagaaatgagcttcctctaacaaccatgagtccatttggaacttctgtgttaaaagccttcagtccaagtcaaatgttgtcagtgagctgtgtccctggggagttctttatgccctgcctcttgcttgatcttttccaggttgttgaacctcagccctctttctctgggtttaatctattgctgttactgcctagacaattttctatcttctcatatctgatcaactgactgtcttgtcccaagtcccttccttccttctactaacctctaacacaaccttaatggaggccaacaagcccttacctaacttctggacattgccagctgctctgcagccccacgcccataactgcaattattgcctatctcaactatctaccccaggcatgcactacacaggaaatcagctcactaatctggttgagttcctgtgtggagctgataatgatgcttttgcatgcttctgctctgattgttttggctaggcctagtggttaatgtggttctttgaacatttctgccttaaaatatataacaaaagtaacgtttaagtatgagtgctcaaattcattatcttaataaaagctgagcacttgttatgtgccaggcactctgctattatcttgtttaatcctatcaatgatcatacaaagaaagacactattattatctccattttacaggtgatgaaaaagagacttaaagagataactaccttttcttgggccacccattgggttggagctccatattttattcttccactatattacttgaaaagaaggctgcatttagacacggtcaagcaatcagttcatgcatttctaagactgctttac

SEQ ID NO: 14945 - DNA, 6354 bp, Homo sapiens
gctctgctgctctcgcgatatttgcgcgagcctgcttccttctttcctcccttgccagtccgcctgtcttcctccccgtcttccctgcccggcctcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccagttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaatttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggccgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatggggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatggaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaagtctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgttggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaaggaagtgtaatgtcagacacacaagaaaagcaaatcagtgttgtaagcttaaagtacaatttcaaaggtcactaccaacagcagggttttttttatactttgaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcacattt

SEQ ID NO: 14946 - DNA, 813 bp, Homo sapiens
tcccgggggtgggcgtccccgggggccgatcgcctccacactcctgccggcctgcgctgttcggccgttccggttaagcagaggctgaacgtgcccggtggcgggggttcccggtggtggcccggagtcctagcctggagacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaa

SEQ ID NO: 14947 - DNA, 1264 bp, Homo sapiens
aatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggctggagtgcagtggtgtgatctcggcttgctgcaacctccacctccctggttcaagcgatcctcccacctcagcctcccaagtagctgggattataggcgcccaccaccatgcctggttcatttttgtatttttagtggagctgtattatcaactcatgtttttgaggaatcctgtatttccaatttttattcaaagctatttattataatttaatttataattaaaattaattatatttgctgctgcccccttcttccaccctataatctgttaaaacctatctaaaataaataatttatcttgtcattggaagtatgcacttagcttgcagttcttacctacatgggagaatgaggcctagattcctaagtgtgctttcttattaaactaaagttataactatcaataaagaccttttaaaaatgtattattttaaaaattataacacattataaaccttaagattttcatcttaaagaagaggtgacttaattatatattgtttatatttagctaatggctcaatttcttgtaaggaagaaagtttttttgttgtttcgttgttttgtttgtttgttgagacagagtcttgctctcttacccaggctggagtgcagtggcacaatcatggttcactgtagcctctgtctcccgggctcaagcagtcctcccacctcagcctcccgagtagctgggactacaggtgcccaccactgtgcccggctaatttttgtatttttagtggagccagggttttgccctgtttcccagactagaaagctttcttaaattgattgtatttgttggctgggcactgtggctcacacctgtaatcccagcactttgggaggccgaggtgggaggatcacttgagcccaggaatgcaagaccagcttgggccacgtggtgaaaccctgactctaaaaaaattagttggtcc

SEQ ID NO: 14948 - DNA, 1958 bp, Homo sapiens
gccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaacactgtatgtatgtagagattgagttgtcaattaaaaaaaatgtggcctctttgtgatcataaaa

SEQ ID NO: 14949 - DNA, 1163 bp, Homo sapiens
ggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcatt

SEQ ID NO: 14950 - DNA, 994 bp, Homo sapiens
ggcgcaggcgcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatgatggtgttctctagtaa

SEQ ID NO: 14951 - DNA, 1168 bp, Homo sapiens
aggcgcaagccggcaagatggcggcggctggggctttccgtctgaggcgggcggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcgggtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatg

SEQ ID NO: 14952 - DNA, 1069 bp, Homo sapiens
aggcgcaagccggcaagatggcggcggctggggctttccgtctgaggcgggcggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatga

SEQ ID NO: 14953 - DNA, 1858 bp, Homo sapiens
ctccccgcgcctttaatactcgcccgctgcggcggtcgccgagtccgcggacatgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccagagagagacctcgtccccaggccagattcgccggcacagcagttaaagtcgcccttccagccggtacgcgacaactctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcggtaaatgcccccacgtgcttgtgtctctttccccccttttctgtatatagagtggtttcagattgtaaatagcgcgtcagcgaacttgtctaaatcatatatttttgtctaataaactaaatgaaatgaca

SEQ ID NO: 14954 - DNA, 2456 bp, Homo sapiens
aaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgtccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttg

SEQ ID NO: 14955 - DNA, 2630 bp, Homo sapiens
ctcccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaggtgtcacaattgctttgaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaataatatgatgtttggggcttatttttcctagaagaatgatttggggtagagcgctagtgaataacctccaggtgatctgacctcacctttttaatgaaaacctgtgtgaaataaactctcctttctctcctgagcattgaaaaaaaaaaaaaaaggcagatggaagagaagtatataatcgggagaaacatgtgctgtagatgatttctatacaggtattgcaaaaaaaccaaaaaacataagatttttgtgccctgagtgtgctaattacttgttagtgtaaatttttaaaacttggcaaaataaaatgatctgacacccta

SEQ ID NO: 14956 - DNA, 2601 bp, Homo sapiens
cgcgcggcaccctaagtgtccacaacttttggctgccttacttagcccagggcgcagaggctggaaaggtcgcggggagtatcgtgtgagtaaagagagagatttacaaaatagaagtagtgagaaaggaagaagtgaagggaacggaccggagagcaaaagccctcgtgagaaagggaaagagaaggggagaggagaaaggagagtttcatagcgtccagggcagtgcaggagcccgaagcagcggaagcgatcctggggggaagaggagtgcggagaggggaggggagaggaagggcgaggagggggagtgaaaactagaggagggcgaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgccgtcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcggcccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccaccgcccggcccccgcctgcacccgctctccctgctgggctctgcccctccgcacctgctgggacttcccggagccgcgggccacccggctgccgccgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 14957 - DNA, 2221 bp, Homo sapiens
tcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtg

SEQ ID NO: 14958 - DNA, 2538 bp, Homo sapiens
gaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcaggtaggtgaggtcccccgctcccgcccccgccccggggttccgagacccctccccccttccgaggaggcggaggctccgcgcggccgccgaggggagcgggcggcggcggctgcggcgactccccggtgcgtcccgggctgcgagctgctccccgcggccccggcagccacacggcgcgggcgggagcttccccagctcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaac

SEQ ID NO: 14959 - DNA, 1990 bp, Homo sapiens
ggtgcgggctcggctgacgaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatgga

SEQ ID NO: 14960 - DNA, 2401 bp, Homo sapiens
cttagcatcttggcaggacctttgcaaaggcaaaagcagagccccccggtgcaaagagcgaggggaaaaaagagaaagcagcaagggaggggaggggaggggaaaaaaagcccagctggggcgagcgaggcgcgcagaggagcgggcgcggcggtcgcagccggaggcgcgcgggaagccagcgaggaggcgccgcgggccggagccccggagccggggccagaggagcggcggcccagggcagccagaggccaggtgcccgcccgctcgccctcgcagggcgccgcccggctcgttggcggccgcggcgcggcgcgccccatgcccgtgtgtggccatgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaa

SEQ ID NO: 14961 - DNA, 881 bp, Homo sapiens
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgctgttgaaaaaagaaaaaaagagccttgacttcccttgttttccccccttgcgcccaacgtgcgtccgctcccccgccgagcgcggagtcgcctcagttgcccaggcctctatctgcatggagggccgggccgccgtggccagatctgcgcacgggggctctccctacgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacag

SEQ ID NO: 14962 - DNA, 711 bp, Homo sapiens
cgcaggctcggcggcacgccccctgacgtgtgtgcctcaggcttataatagggccggtgctgcctgccgaagccggcggctgagaggcagcgaactcatctttgccagtacaggagcttgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 14963 - DNA, 2755 bp, Homo sapiens
caggcggcgcggccgggaaggaacgcgggaggggacagaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcctgacgtccccgcgcgctgcgtcagaccaatggcgatggagctgagttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaa

SEQ ID NO: 14964 - DNA, 981 bp, Homo sapiens
atgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactgctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatga

SEQ ID NO: 14965 - DNA, 1958 bp, Homo sapiens
gattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaattta

SEQ ID NO: 14966 - DNA, 351 bp, Homo sapiens
aagcttggactcttttcttgaagctttctttctatcagaagcatttgctgatattgctgacattgaaacattaaaagtgctggattattctttgcagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaa

SEQ ID NO: 14967 - DNA, 409 bp, Homo sapiens
agctttgcacatctccaggtcagacctatcctaatatctacatctacatttccagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgccctt

SEQ ID NO: 14968 - DNA, 2309 bp, Homo sapiens
ctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgta

SEQ ID NO: 14969 - DNA, 1415 bp, Homo sapiens
taccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataa

SEQ ID NO: 14970 - DNA, 2133 bp, Homo sapiens
gctgcaggaagcagcaggagacgcccggcagccgggacggtcggggacgcctgaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttg

SEQ ID NO: 14971 - DNA, 2458 bp, Homo sapiens
gctgcgctgcggtgcgcacgggctccgccggttgctattccggctggtggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgcaaa

SEQ ID NO: 14972 - DNA, 2383 bp, Homo sapiens
actctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgc

SEQ ID NO: 14973 - DNA, 1539 bp, Homo sapiens
atgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaatatttacagaatatttgcctcgagatgaaagcaaattcagatattaagatgctacagaaagggaaagaaggccagcaaattggcatattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatga

SEQ ID NO: 14974 - DNA, 551 bp, Homo sapiens
gggggcgcgccgggcgggctgcaggaagcagcaggagacgcccggcagccgggacggtcggggacgcctggttataatataacttatcctctcatgcttttttcctgccccttctccccaaatcatcaacaatagaagaagaagaaaacatgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgt

SEQ ID NO: 14975 - DNA, 604 bp, Homo sapiens
ggatccgagcgggggataccccaggagatgggggtcgaggagagaccccggggagtagagagagagaaactcactccccgagtccccgaccctccccaagcaagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgc

SEQ ID NO: 14976 - DNA, 1170 bp, Homo sapiens
aaaacggacggtgcagggggtgggccacgtgtccagccctaacgaaacggtaaccagccctgggaagcccgcaagaggcctcagcggtggccgtccgagagccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttggacccccgttcttatccggggttggccctgacctctctctacccacagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggctgtggaccaaa

SEQ ID NO: 14977 - DNA, 1122 bp, Homo sapiens
aaaacggacggtgcagggggtgggccacgtgtccagccctaacgaaacggtaaccagccctgggaagcccgcaagaggcctcagcggtggccgtccgagagccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggctgtggaccaaa

SEQ ID NO: 14978 - DNA, 912 bp, Homo sapiens
aaaacggacggtgcagggggtgggccacgtgtccagccctaacgaaacggtaaccagccctgggaagcccgcaagaggcctcagcggtggccgtccgagagccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggctgtggaccaaa

SEQ ID NO: 14979 - DNA, 4128 bp, Homo sapiens
cgtgcaggggcgggctccgagcgtggggtgggcgcttgcgcactgccgctgcggctgttgctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactgagatgtttgctttctctacctgtttcctgttcagatgccttcggtcattttggctcagcttgctactgagaatggctgcttcccgtattcagaatggaagtggggtggtctggtggcgacaggctaacgtagagctggctgcttttatgagaatgcgccacttgaccccatcctgcacctttgtttattccagggcactaatggtcactcgcatgcccgctgtgcacagtcctgtgagttaaatgcccactactctctgcactggtcccacctgctcaattgacaaaaaaaatcaggtccttgttgacagttctgttaaaaggtttaatattcaaattatacattaaatagaatcaaacaggcagcagcagttttattaagcatcaagtcagttggcatgtgggtggcggagtgcctggtaatggaataatagggtcggcgatgcccgccaagattccagagtaagtcaggtcgctaggtgagttgtgactgattgcttttcctgcagcgcacgtgagcagtatcagccatctctctcctacccgctccacagcctactgctggctgtcctgtatgtgagctagcagctttttaatctacctggaactaaggccaaaaattatcagccctttcgttctggaaggagagctgatctcatttgtcacctgaacaaaaagcaatacttaaactgaattaaaactacccacacgtgaagcttcttggaattgtcagctattgttggcgtaagacctggtaaatgtagagccagtgctgtgccctgacctggagatctaacagacttggcagaaatgcctgtgcccagactgaagagacctggggctcaggaagaggctcggaacgcctgccctctattctatagaaactgcaggcataggccctgattacattttttgctcttggtaaaaggagtcaatgatacctttgtacttctccaaaactgtgagccgtttcagtttcatcgtgggacctaaaagggaaatgagaagaaatgagtgaggcccaggctctgagaactctgagaatgtgtgtggtaaagactcacactcagtcctatatataactcaggaattaagccagataatcaggaccgtcagtagccagcctccaagacagtgatcgctcctggtattcatatggcttgtgtgtagtctcctgtgttataccactggttgtggccagtggagtatagatgaagggttggtatgtcacctctgagaataggttataaaagatcagtttcttttatacacataggaaagtagtgtaagctacatctgccttttccttgacctgtacccagttttgaccctcagtccattttctctgaaatggatttatttgttccatctcttgaatgaataaattgttgaagcaattaaaaaataga

SEQ ID NO: 14980 - DNA, 1037 bp, Homo sapiens
aggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaat

SEQ ID NO: 14981 - DNA, 501 bp, Homo sapiens
gcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatgactcggcacaacaatctagacctggtgatcattcgaga

SEQ ID NO: 14982 - DNA, 1545 bp, Homo sapiens
gtcacttcccacgcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 14983 - DNA, 1230 bp, Homo sapiens
gtcacttcccacgcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 14984 - DNA, 1627 bp, Homo sapiens
gcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgaggtgaggccccagaaactgggggagggcaaggatgaagatgggagagaggtggagctccttgtttcccttcccagtgtcacctagctgctgctttcttcttacccagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacc

SEQ ID NO: 14985 - DNA, 1485 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctaga

SEQ ID NO: 14986 - DNA, 1255 bp, Homo sapiens
cgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagtaagtacctgccccctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatggcctggtgtgtgccgagcctgcctgtgtcctacagatgcacactccggacatcgggggccagggcacaacatctgaagccatccaggacgtcatccgccacatccgcgtcatcaacggccgggccgtggaggcctag

SEQ ID NO: 14987 - DNA, 1712 bp, Homo sapiens
ggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctaga

SEQ ID NO: 14988 - DNA, 697 bp, Homo sapiens
ctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggcgagatgcagtggatcattcctgaaatctaccacttttggaagccaaggtggagtattgctcctggaaaatccaaaaggtgacaataggttggaccttttaaagctgaagagtgttgtcactagcatttttggtgtgaaaaatacagagctggctgtcttccatgatgaaacag

SEQ ID NO: 14989 - DNA, 4382 bp, Homo sapiens
agcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggcgagatgcagtggatcattcctgaaatctaccacttttggaagccaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 14990 - DNA, 4656 bp, Homo sapiens
tccgtgcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaa

SEQ ID NO: 14991 - DNA, 4341 bp, Homo sapiens
cgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatcccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 14992 - DNA, 1103 bp, Homo sapiens
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgct

SEQ ID NO: 14993 - DNA, 583 bp, Homo sapiens
ggacgccggatgagttgcttttaggcttgctggcccgcggggctgtccaggcacgcgaggcccctcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtg

SEQ ID NO: 14994 - DNA, 4406 bp, Homo sapiens
cggtgcggagcctgtctccttcactggatcccgcattttcagcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 14995 - DNA, 4186 bp, Homo sapiens
gcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaagaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 14996 - DNA, 854 bp, Homo sapiens
aagagaatggcgctttcactgtgcttgttgacaactatgtgaaggaagaagaaggcacaggggttgtccaccaagctccttacttcggtgctgaggactatcggacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtc

SEQ ID NO: 14997 - DNA, 3688 bp, Homo sapiens
agcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 14998 - DNA, 1280 bp, Homo sapiens
atgatggtcctccttttgcaactggactgcctcactatggacatatacttgcgggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 14999 - DNA, 3542 bp, Homo sapiens
ggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctgg

SEQ ID NO: 15000 - DNA, 3557 bp, Homo sapiens
cttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaa

SEQ ID NO: 15001 - DNA, 4771 bp, Homo sapiens
cgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 15002 - DNA, 380 bp, Homo sapiens
cgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtcacatctagtgcatccccacagccactgtaggatttttccctacactatgatttcagtcccttga
